United States Patent
Park et al.

(10) Patent No.: US 10,323,256 B2
(45) Date of Patent: Jun. 18, 2019

(54) TRANSGENIC PLANTS HAVING ALTERED BIOMASS COMPOSITION

(71) Applicant: CERES, INC., Thousand Oaks, CA (US)

(72) Inventors: Joon-Huyn Park, Oak Park, CA (US); Roger I. Pennell, Malibu, CA (US); Richard Flavell, Thousands Oaks, CA (US); Chuan-Yin Wu, Newbury Park, CA (US)

(73) Assignee: Ceres, Inc., Thousand Oaks, CA (US)

( * ) Notice: Subject to any disclaimer, the term of this patent is extended or adjusted under 35 U.S.C. 154(b) by 239 days.

(21) Appl. No.: 14/363,151

(22) PCT Filed: Dec. 10, 2012

(86) PCT No.: PCT/US2012/068756
§ 371 (c)(1),
(2) Date: Jun. 5, 2014

(87) PCT Pub. No.: WO2013/086499
PCT Pub. Date: Jun. 13, 2013

(65) Prior Publication Data
US 2015/0052634 A1    Feb. 19, 2015

Related U.S. Application Data

(60) Provisional application No. 61/568,747, filed on Dec. 9, 2011.

(51) Int. Cl.
C12N 15/82 (2006.01)
C07K 14/415 (2006.01)

(52) U.S. Cl.
CPC ........ *C12N 15/8297* (2013.01); *C07K 14/415* (2013.01); *C12N 15/8245* (2013.01); *C12N 15/8246* (2013.01); *C12N 15/8261* (2013.01); *Y02A 40/146* (2018.01)

(58) Field of Classification Search
None
See application file for complete search history.

(56) References Cited

U.S. PATENT DOCUMENTS

| | | |
|---|---|---|
| 4,987,071 A | 1/1991 | Cech et al. |
| 5,034,323 A | 7/1991 | Jorgensen et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,538,880 A | 7/1996 | Lundquist et al. |
| 5,612,191 A | 3/1997 | Briggs et al. |
| 5,766,847 A | 6/1998 | Jackle et al. |
| 5,773,282 A | 6/1998 | Tsusaki et al. |
| 5,874,274 A | 2/1999 | Jakobsen et al. |
| 5,878,215 A | 3/1999 | Kling et al. |
| 5,939,533 A | 8/1999 | Lilja et al. |
| 6,013,863 A | 1/2000 | Lundquist et al. |
| 6,090,595 A | 7/2000 | Foody et al. |
| 6,198,021 B1 | 3/2001 | Lange et al. |
| 6,326,527 B1 | 12/2001 | Kirihara et al. |
| 6,329,571 B1 | 12/2001 | Hiei |
| 6,333,181 B1 | 12/2001 | Ingram et al. |
| 6,423,885 B1 | 7/2002 | Waterhouse et al. |
| PP13,008 P2 | 9/2002 | Walsh |
| 6,452,067 B1 | 9/2002 | Bedbrook et al. |
| 6,455,675 B1 | 9/2002 | Lange et al. |
| 6,573,099 B2 | 6/2003 | Graham |
| 6,677,502 B1 | 1/2004 | Allen |
| 6,723,897 B2 | 4/2004 | Brown et al. |
| PP14,743 P2 | 5/2004 | Speichert et al. |
| 6,753,139 B1 | 6/2004 | Baulcombe et al. |
| 6,777,588 B2 | 8/2004 | Waterhouse et al. |
| PP15,193 P2 | 9/2004 | Smith et al. |
| 6,906,244 B2 | 6/2005 | Fischer et al. |
| 6,921,848 B2 | 7/2005 | Chory et al. |
| 6,921,849 B2 | 7/2005 | Amasino et al. |
| PP16,176 P3 | 1/2006 | Cosner et al. |
| 7,049,490 B2 | 5/2006 | Tanaka et al. |
| 7,059,993 B2 | 6/2006 | Ding et al. |
| 7,112,429 B2 | 9/2006 | Ding et al. |
| 7,195,917 B2 | 3/2007 | Brown et al. |
| PP18,161 P2 | 10/2007 | Probst |
| 7,420,102 B2 | 9/2008 | Amasino et al. |
| 7,575,917 B2 | 8/2009 | Gilbertson et al. |
| 7,807,878 B2 | 10/2010 | Eriksson et al. |

(Continued)

FOREIGN PATENT DOCUMENTS

| | | |
|---|---|---|
| EP | 0534858 | 5/2000 |
| WO | WO 93/16096 | 8/1993 |

(Continued)

OTHER PUBLICATIONS

Sorghum bicolor protein XP_002463483.1, published Jul. 13, 2009.*
Keskin et al., 2004, Protein Science 13: 1043-1055.*
Guo et al., 2004, Proceedings of the National Academy of Sciences USA 101: 9205-9210.*
Thornton et al., 2000, Nature Structural Biology, structural genomic supplement, Nov. 2000: 991-994.*
Pérez-Flores et al., 2003, Journal of Experimental Botany 54: 2071-2079.*
Sorghum bicolor gibberellin 20-oxidase (GA20ox) mRNA, GenBank: AF249881.1, published May 18, 2000.*
de Souza et al., 2010, Brazilian Journal of Microbiology 41: 850-861.*

(Continued)

*Primary Examiner* — Bratislav Stankovic
(74) *Attorney, Agent, or Firm* — Dentons US LLP

(57) ABSTRACT

Methods and materials for modulating biomass composition in plants are disclosed. For example, nucleic acids encoding biomass composition-modulating polypeptides are disclosed as well as methods for using such nucleic acids to transform plant cells. Also disclosed are plants having altered biomass composition and plant products produced from plants having altered biomass composition.

3 Claims, 63 Drawing Sheets
Specification includes a Sequence Listing.

(56) References Cited

U.S. PATENT DOCUMENTS

| | | |
|---|---|---|
| 7,915,050 B2 | 3/2011 | Matsuoka et al. |
| 7,985,888 B2 | 7/2011 | Phillips et al. |
| 2003/0175783 A1 | 9/2003 | Waterhouse et al. |
| 2003/0175965 A1 | 9/2003 | Lowe et al. |
| 2003/0180945 A1 | 9/2003 | Wang et al. |
| 2003/0217388 A1 | 11/2003 | Feyereisen et al. |
| 2004/0214330 A1 | 10/2004 | Waterhouse et al. |
| 2005/0032221 A1 | 2/2005 | Chang et al. |
| 2005/0223422 A1 | 10/2005 | Cook et al. |
| 2005/0223434 A1 | 10/2005 | Alexandrov et al. |
| 2005/0229270 A1 | 10/2005 | Fischer et al. |
| 2005/0246785 A1 | 11/2005 | Cook et al. |
| 2006/0010518 A1 | 1/2006 | Feldmann et al. |
| 2006/0015970 A1 | 1/2006 | Pennell et al. |
| 2006/0021083 A1 | 1/2006 | Cook et al. |
| 2006/0041952 A1 | 2/2006 | Cook |
| 2006/0057724 A1 | 3/2006 | Alexandrov et al. |
| 2006/0090216 A1 | 4/2006 | Apuya et al. |
| 2006/0112445 A1 | 5/2006 | Dang |
| 2006/0112454 A1 | 5/2006 | Christensen et al. |
| 2006/0134786 A1 | 6/2006 | Feldmann |
| 2006/0143729 A1 | 6/2006 | Alexandrov et al. |
| 2006/0150285 A1 | 7/2006 | Nadzan et al. |
| 2006/0168696 A1 | 7/2006 | Feldmann et al. |
| 2006/0195943 A1 | 8/2006 | Feldmann et al. |
| 2006/0260004 A1 | 11/2006 | Fang et al. |
| 2006/0265777 A1 | 11/2006 | Apuya et al. |
| 2006/0265788 A1 | 11/2006 | Rommens |
| 2006/0294622 A1 | 12/2006 | Sosa et al. |
| 2007/0006335 A1 | 1/2007 | Cook et al. |
| 2007/0006337 A1 | 1/2007 | Cook et al. |
| 2007/0006345 A1 | 1/2007 | Alexandrov et al. |
| 2007/0006346 A1 | 1/2007 | Alexandrov et al. |
| 2007/0011783 A1 | 1/2007 | Liu et al. |
| 2007/0039067 A1 | 2/2007 | Feldmann et al. |
| 2007/0042387 A1 | 2/2007 | Pennell et al. |
| 2007/0056058 A1 | 3/2007 | Olivier et al. |
| 2007/0061914 A1 | 3/2007 | Feldmann |
| 2007/0083953 A1 | 4/2007 | Christensen et al. |
| 2007/0092935 A1 | 4/2007 | Jones et al. |
| 2007/0094750 A1 | 4/2007 | Jofuku |
| 2007/0101460 A1 | 5/2007 | Feldman et al. |
| 2007/0174936 A1 | 7/2007 | Alexandrov et al. |
| 2007/0192907 A1 | 8/2007 | Alexandrov et al. |
| 2007/0214517 A1 | 9/2007 | Alexandrov et al. |
| 2007/0277269 A1 | 11/2007 | Alexandrov et al. |
| 2008/0072340 A1 | 3/2008 | Troukhan et al. |
| 2008/0131581 A1 | 6/2008 | Schneeberger et al. |
| 2009/0031441 A1 | 1/2009 | Matsuoka et al. |
| 2009/0094717 A1* | 4/2009 | Troukhan ............ C07K 14/415 800/290 |
| 2011/0214199 A1 | 9/2011 | Coffin |

FOREIGN PATENT DOCUMENTS

| | | |
|---|---|---|
| WO | WO 1994/028141 | 12/1994 |
| WO | WO 97/01952 | 1/1997 |
| WO | WO 98/36083 | 8/1998 |
| WO | WO 98/53083 | 11/1998 |
| WO | WO 99/32619 | 7/1999 |
| WO | WO 02/46449 | 6/2002 |
| WO | WO 2005/098007 | 10/2005 |
| WO | WO 2006/005023 | 1/2006 |
| WO | WO 2006/032916 | 3/2006 |
| WO | WO 2006/034479 | 3/2006 |
| WO | WO 2006/036864 | 4/2006 |
| WO | WO 2007/044988 | 4/2007 |
| WO | WO 2007/055826 | 5/2007 |
| WO | WO 2007/120989 | 10/2007 |
| WO | WO 2008/049183 | 5/2008 |
| WO | 2009/031441 A1 * | 1/2009 |
| WO | WO 2009/009142 | 1/2009 |
| WO | WO 2009/099899 | 8/2009 |
| WO | WO 2009/102965 | 8/2009 |
| WO | WO 2009/146015 | 10/2009 |
| WO | WO 2009/134339 | 11/2009 |
| WO | WO 2010/033564 | 3/2010 |
| WO | WO 2010/083178 | 7/2010 |
| WO | WO 2010/127969 | 11/2010 |
| WO | WO 2011/011412 | 1/2011 |
| WO | WO 2011/140329 | 11/2011 |
| WO | WO 2012/009551 | 1/2012 |

OTHER PUBLICATIONS

Appleford and Lenton, 1997, Physiologia Plantarum 100: 534-542.*
U.S. Appl. No. 60/505,689, filed Sep. 23, 2003, Cook et al.
U.S. Appl. No. 60/518,075, filed Nov. 6, 2003, Pennell et al.
U.S. Appl. No. 60/544,771, filed Feb. 13, 2004, Cook et al.
U.S. Appl. No. 60/558,869, filed Apr. 1, 2004, Cook et al.
U.S. Appl. No. 60/583,609, filed Jun. 30, 2004, Alexandrov.
U.S. Appl. No. 60/583,691, filed Jun. 30, 2004, Alexandrov et al.
U.S. Appl. No. 60/612,891, filed Sep. 23, 2004, Kwok.
U.S. Appl. No. 60/619,181, filed Oct. 14, 2004, Medrano.
U.S. Appl. No. 60/637,140, filed Dec. 16, 2004, Feldmann.
U.S. Appl. No. 60/757,544, filed Jan. 9, 2006, Dang.
U.S. Appl. No. 60/776,307, filed Feb. 24, 2006, Kwok.
Abler et al. "Isolation and characterization of a genomic sequence encoding the maize Cat3 catalase gene" Plant Mol. Biol., 1993, 22:1031-1038.
Akashi et al., "Gene Discovery by Ribozyme and siRNA Libraries," Nature Reviews Mol. Cell Biology, May 2005, 6:413-422.
Alonso-Blanco et al. "Arabidopsis Protocols," Methods in Molecular Biology, 1998, 82:137-146.
Aravind and Koonin, "The DNA-repair protein AlkB, EGL-9, and leprecan define new families of 2-oxoglutarate- and iron-dependent dioxygenases," Genome Biol., 2001, 2(3):RESEARCH0007.
Baerson et al., "Developmental regulation of an acyl carrier protein gene promoter in vegetative and reproductive tissues," Plant Mol. Biol., 1993, 22(2):255-267.
Bateman et al., "Pfam 3.1: 1313 multiple alignments and profile HMMs match the majority of proteins," Nucl. Acids Res., 1999, 27:260-262.
Bolle, et al., "PAT1, a new member of the GRAS family, is involved in phytochrome a signal transduction," Genes Dev., 2000, 14(10):1269-1278.
Braga et al., "Expression of the Cry1Ab Protein in Genetically Modified Sugarcane for the Control of Diatraea saccharalis (Lepidoptera: Crambidae)," Journal of New Seeds, 2003, 5:209-221.
Burr et al. "Gene mapping with recombinant inbreds in maize," Genetics, 1998, 118(3):519-526.
Burr et al., "Mapping Genes with Recombinant Inbreds," The Maize Handbook, 1994, pp. 249-254.
Bustos et al., "Regulation of B-Glucuronidase Expression in Transgenic Tobacco Plants by an A/T-Rich, cis-Acting Sequence Found Upstream of a French Bean B-Phaseolin Gene," The Plant Cell, 1989, 1(9):839-853.
Cerdan et al., "A 146 bp fragment of the tobacco Lhcb1*2 promoter confers very-low-fluence and high-irradiance responses of phytochrome to a minimal CaMV 35S promoter," Plant Mol. Biol., 1997, 33:245-255.
Chen et al., "Functional analysis of regulatory elements in a plant embryo-specific gene," Proc. Natl. Acad. Sci. USA, 1986, 83:8560-8564.
Chenna et al., "Multiple sequence alignment with the Clustal series of programs," Nucleic Acids Res., 2003, 31(13):3497-3500.
Christian, et al., "Targeting DNA Double-Strand Breaks with TAL Effector Nucleases," Genetics, Oct. 2010, 186:757-761.
Conceicao, "A cotyledon regulatory region is responsible for the different spatial expression patterns of Arabidopsis 2S albumin genes," The Plant Journal, 1994, 5(4):493-505.
Conkling et al., "Isolation of Transcriptionally Regulated Root-Specific Genes from Tobacco," Plant Physiol., 1990, 93:1203-1211.
Dai et al., "RF2b, a rice bZIP transcription activator, interacts with RF2a and is involved in symptom development of rice tungro disease," Proc. Natl. Acad. Sci. USA, 2004, 101(2):687-692.

(56) References Cited

OTHER PUBLICATIONS de Feyter and Gaudron, "Expressing Ribozymes in Plants," Methods in Molecular Biology, 74(43).
Dieffenbach and Dveksler, "PCR Primer: A Laboratory Manual," Cold Spring Harbor Laboratory Press, 1995, 520 pages.
Do et al., "ProbCons: Probabilistic consistency-based multiple sequence alignment," Genome Res., 2005, 15(2):330-40.
Durbin et al., Biological Sequence Analysis: Probabilistic Models of Proteins and Nucleic Acids, Cambridge University Press, Cambridge, UK (1998).
Fejes et al., "A 268 bp upstream sequence mediates the circadian clock-regulated transcription of the wheat Cab-1 gene in transgenic plants," Plant Mol. Biol., 1990, 15:921-932.
Fromm et al., An Octopine Synthase Enhancer Element Directs Tissue-Specific Expression and Binds ASF-1, a Factor from Tobacco Nuclear Extracts, The Plant Cell, 1989, 1:977-984.
Fujisawa et al., "Suppression of the heterotrimeric G protein causes abnormal morphology, including dwarfism, in rice," Proc. Natl. Acad. Sci. USA, 1999, 96: 7575-7580.
Garcia-Hurtado et al., "The characterization of transgenic tomato over-expressing gibberellin 20-oxidase reveals induction of parthenocarpic fruit growth, higher yield and alteration of the gibberllin biosynthetic pathway," 30 pages.
Gardiner et al., "Development of a Core RFLP Map in Maize Using an Immortalized F2 Population," Genetics Society of America, 1993, 134: 917-930.
GenBank Accession No. L05934 GI: 168436, "Isolation and Characterization of a Genomic Sequence Encoding the Maize Cat3 Catalase Gene," dated Oct. 22, 1993, 3 pages.
GenBank Accession No. U93215 GI: 20198323, "Arabidopsis thaliana chromosome 2 BAC T6B20 genomic sequence," dated Feb. 27, 2002, 37 pages.
GenBank Accession No. AF129516 GI: 4567094, "Mutations in FIE, a WD polycomb group gene, allow endosperm development without fertilization," dated Apr. 6, 1999, 2 pages.
GenBank Accession No. AF096096 GI: 4185500, "Genes controlling fertilization-independent seed development in *Arabidopsis thaliana*," dated Jan. 25, 1999, 2 pages.
Green et al., "Binding site requirements for pea nuclear protein factor GT-1 correlate with sequences required for light-dependent transcriptional activation of the rbcS-3A gene," The EMBO J., 1988, 7:4035-4044.
Hedden and Phillips, "Gibberellin metabolism: new insights revealed by the genes," Trends Plant Sci., 2000, 5(12):523-530.
Hong et al., "Promoter sequences from two different *Brassica napus* tapetal oleosin-like genes direct tapetal expression of B-glucuronidase in transgenic *Brassica* plants," Plant Mol. Biol., 1997, 34(3):549-555.
Hwang et al. "Aleurone- and embryo-specific expression of the β-glucuronidase gene controlled by the barley Chi26 and Ltp1 promoters in transgenic rice," Plant Cell Reports, 2001, 20:647-654.
Hyrup et al., "Peptide Nucleic Acids (PNA): Synthesis, Properties and Potential Applications," Bioorganic & Medicinal Chemistry, 1996, 4(1):5-23.
International Preliminary Report on Patentability in Application No. PCT/US2012/068756, dated Aug. 19, 2014, 15 pages.
International Search Report and Written Opinion in Application No. PCT/US2012/068756, dated Mar. 19, 2013, 24 pages.
Jordano et al., "A Sunflower Helianthinin Gene Upstream Sequence Ensemble Contains an Enhancer and Sites of Nuclear Protein Interaction," The Plant Cell, 1989, 1:855-866.
Kaneko et al., Where do gibberellin biosynthesis and gibberellin signaling occur in rice plants? The Plant Journal., 2003, 35: 104-115.
Kasuga et al., "Improving plant drought, salt, and freezing tolerance by gene transfer of a single stress-inducible transcription factor," Nature Biotechnology, 1999, 17:287-291.
Keller and Baumgartner, "Vascular-Specific Expression of the Bean GRP 1.8 Gene is Negatively Regulated," The Plant Cell, 1991, 3(10):1051-1061.

Lam et al., "Site-specific mutations alter in vitro factor binding and change promoter expression pattern in transgenic plants," Proc. Natl. Acad. Sci. USA, 1989, 86:7890-7894.
Li et al., "Small dsRNAs induce transcriptional activation in human cells," Proc Natl Acad Sci USA, 2006, 103(46):17337-42.
Lloyd et al., "Targeted mutagenesis using zinc-finger nucleases in Arabidopsis," Proc. Natl. Acad. Sci. USA, Feb. 2005, 102:2232-2237.
Lu et al., "A study on the application and residues of plant growth regulators in the fruit sugarcane grown in the sub-suitable region," Journal of Agricultural Science, 2010, 2(4): 254-256.
Luan et al., A Rice cab Gene Promoter Contains Separate cis-Acting Elements That Regulate Expression in Dicot and Monocot Plants, the Plant Cell, Aug. 1992, 4:971-981.
Lubberstedt et al., "Promoters from Genes for Plastid Proteins Possess Regions with Different Sensitivities toward Red and Blue Light," Plant Physiol., 1994, 104:997-1006.
Martins et al., "Effects of gibberellin and ethephon on the anatomy of sugar cane plants," Pesq. Agropec. Bras, Brasilia, 1999, 35(10): 1855-1863.
Matsuoka et al., "Tissue-specific light-regulated expression directed by the promoter of a C4 gene, maize pyruvate, orthophosphate dikinase, in a C3 plant, rice," Proc. Natl. Acad. Sci. USA, Oct. 1993, 90:9586-9590.
Matzke and Birchler, "RNAi-Mediated Pathways in the Nucleus," Nature Reviews Genetics, Jan. 2005, 6:24-35.
McCallum et al., "Targeted screening for induced mutations," Nature Biotechnology, Apr. 2000, 18:455-457.
Medberry et al., "The Commelina Yellow Mottle Virus Promoter Is a Strong Promoter in Vascular and Reproductive Tissues," The Plant Cell, Feb. 1992, 4(2):185-192.
Meier et al., "Elicitor-Inducible and Constitutive in Vivo DNA Footprints Indicate Novel cis-Acting Elements in the Promoter of a Parsley Gene Encoding Pathogenesis-Related Protein 1," The Plant Cell, Mar. 1991, 3:309-316.
Mittal, "Improving the Efficiency of RNA Interference in Mammals," Nature Reviews Genetics, May 2004, 5:355-365.
Moore and Haber, "Cell cycle and genetic requirements of two pathways of nonhomologous end-joining repair of double-strand breaks in *Saccharomyces cerevisiae*," Mol Cell Biol., May 1996, 16(5):2164-73.
Murase, et al., "Gibberellin-induced DELLA recognition by the gibberellin receptor GID1," Nature, 2008, 456(7221):459-463.
Nardini et al., "Alpha/beta hydrolase fold enzymes: the family keeps growing," Curr. Opin. Struct. Biol., 1999, 9(6):732-737.
Nature.Com, "Nature Reviews RNA interference collection," Oct. 2005, [retrieved on Apr. 12, 2012]. Retrieved from Internet: URL http://www.nature.com/focus/rnai/index.html. 2 pages.
Oikawa et al., "A role of OsGA20ox1, encoding an isoform of gibberellin 20-oxidase, for regulation of plant stature in rice," Plant Mol. Biol., 2004, 55(5):687-700.
Ollis et al., "The alpha/beta hydrolase fold," Protein Eng., 1992, 5(3):197-211.
Perriman et al., "Effective ribozyme delivery in plant cells," Proc. Natl. Acad. Sci. USA, Jun. 1995, 92(13):6175-6179.
Pinot and Beisson, "Cytochrome P450 metabolizing fatty acids in plants: characterization and physiological roles," FEBS J., 2011, 278(2):195-205.
Pysh et al., "The GRAS gene family in *Arabidopsis*: sequence characterization and basic expression analysis of the Scarecrow-Like genes," Plant J., 1999, 18(1):111-119.
Refseth et al., "Hybridization capture of microsatellites directly from genomic DNA," Electrophoresis, 1997, 18(9):1519-1523.
Riggs et al., "Cotyledon Nuclear Proteins Bind to DNA Fragments Harboring Regulatory Elements of Phytohemagglutinin Genes," The Plant Cell, Jun. 1989, 1(6):609-621.
Rivera et al., "Genomic evidence for two functionally distinct gene classes," Proc. Natl. Acad. Sci. USA, May 1998, 95:6239-6244.
Sheridan et al., "The mac1 Gene: Controlling the Commitment to the Meiotic Pathway in Maize," Genetics, 1996, 142:1009-1020.
Shibuya et al., "RNA-directed DNA methylation induces transcriptional activation in plants," Proc Natl Acad Sci USA, Feb. 2009,106(5):1660-1665.

(56) References Cited

OTHER PUBLICATIONS

Slocombe et al., "Temporal and Tissue-Specific Regulation of a *Brassica napus* Stearoyl-Acyl Carrier Protein Desaturase Gene," Plant Physiol., 1994, 104(4):167-176.

Sonnhammer et al., "Pfam: A Comprehensive Database of Protein Domain Families Based on Seed Alignments," Proteins, 1997, 28:405-420.

Sonnhammer et al., "Pfam: multiple sequence alignments and HMM-profiles of protein domains,". Nucl. Acids Res., 1998, 26:320-322.

Stemple, "Tilling—a high-throughput harvest for functional genomics," Nat Rev Genet, Feb. 2004, 5(2):145-50.

Summerton and Weller, "Morpholino Antisense Oligomers: Design, Preparation, and Properties," Antisense Nucleic Acid Drug Dev., 1997, 7:187-195.

Tovkach et al., "A toolbox and procedural notes for characterizing novel zinc finger nucleases for genome editing in plant cells," The Plant Journal, 2009, 57:747-757.

Townsend et al., "High-frequency modification of plant genes using engineered zinc-finger nucleases," Nature, May 2009, 459:442-445.

Truernit et al., "The promoter of the Arabidopsis thaliana SUC2 sucrose-H+ symporter gene directs expression of B-glucuronidase to the phloem: Evidence for phloem loading and unloading by SUC2," Planta, 1995, 196:564-570.

Ueguchi-Tanaka et al., "Rice dwarf mutant d1, which is defective in the subunit of the heterotrimeric G protein, affects gibberellin signal transduction," PNAS, 2000, 97(21): 11638-11643.

Urao, "Molecular cloning and characterization of a gene that encodes a MYC-related protein in *Arabidopsis*," Plant Mol. Biol., 1996, 32(3):571-576.

Vidal, A.M. et al. "The ectopic overexpression of a citrus gibberellin 20-oxidase enhances the non-13-hydroxylation pathway of gibberellin biosynthesis and induces an extremely elongated phenotype in tobacco," Physiologia Plantarum, 2001, 112(2):251-260.

Voegele et al., "Members of the gibberellin receptor gene family GID1 (Gibberellin Insensitive DWARF1) play distinct roles during *Lepidium sativum* and *Arabidopsis thaliana* seed germination," J. Exp. Botany, 2011, 62(14):5131-5147.

Vogel and Jung, "Genetic Modification of Herbaceous Plants for Feed and Fuel," Critical Reviews in Plant Sciences, 2001, 20(1):15-49.

Weigel et al., "Activation Tagging in *Arabidopsis*," Plant Physiology, Apr. 2000, 122:1003-1013.

Yamamoto et al., "The Promoter of a Pine Photosynthetic Gene Allows Expression of a B-Glucuronidase Reporter Gene in Transgenic Rice Plants in a Light-Independent but Tissue-Specific Manner," Plant Cell Physiol., 1994, 35:773-778.

Yan et al., "New Construct Approaches for Efficient Gene Silencing in Plants," Plant Physiol., Aug. 2006, 141:1508-1518.

Zhang et al., "DNA sequences that activate isocitrate lyase gene expression during late embryogenesis and during postgerminative growth," Plant Physiology, 1996, 110(4):1069-1079.

Zheng et al., "SPK1 Is an Essential S-Phase-Specific Gene of *Saccharomyces cerevisiae* That Encodes a Nuclear Serine/Threonine/Tyrosine Kinase," Mol. Cell Biol., Sep. 1993, 13:5829-5842.

\* cited by examiner

| SEQ ID NO | Sequence | # |
|---|---|---|
| SEQ_ID_NO_471 | QEQEV VFDAA VLSGQTE PS QFI WPAEESP GSVA- VEELE | 45 |
| SEQ_ID_NO_473 | PPPSL VFDAA RLSGLSDI PQ QFL WPADESP TPDA- AEELA | 54 |
| SEQ_ID_NO_475 | DPPPL VFDAA RLSGLSDI PS QFI WPADESP TPDS- AEELA | 45 |
| SEQ_ID_NO_476 | ----- QPVFDAA LLSGQSDI PS QFI WPEGESP TPDA- AEELH | 38 |
| SEQ_ID_NO_477 | ----- QPVFDAA VLSGRTDI PS QFI WPADESP TPDA- TEELH | 38 |
| SEQ_ID_NO_478 | ----- QPVFDAA VLSGRADI PS QFI WPEGESP TPDA- TEEMH | 38 |
| SEQ_ID_NO_479 | ----- QPVFDSA VLQHETNI PQ QFI WPEGESP NSKK- AEELH | 38 |
| SEQ_ID_NO_480 | QQRSL VFDASL VLQHEGNI PQ QFI WPDNEKP NTQK- SKDLE | 62 |
| SEQ_ID_NO_481 | RQRSL VFDAS LLQHETNI PQ QFI WPDHEKP NLQK- SKELE | 58 |
| SEQ_ID_NO_482 | QKTPL VFDAS HMKRESNI PT QFI WPDHEKP CAV-- TKELV | 57 |
| SEQ_ID_NO_483 | EKKTLI FDAS VLKHQTQI PK QFI WPDDEKP CVN-- AQQLA | 54 |
| SEQ_ID_NO_484 | EQKPL VFDAS KL KRESNI PT EFI WPDAEKP CAV-- APELP | 60 |
| SEQ_ID_NO_485 | DKKPL VFDAS VLRHQSNI PK QFI WPDHEKP SAN-- AQELP | 54 |
| SEQ_ID_NO_487 | EQKKL VFDAS QMKREYNI PQ QFV WPDHEKP GDK-- ATELS | 60 |
| SEQ_ID_NO_488 | NQEPL VFDAS VLRHQTNI PT QFI WPDHEKP RAV-- ARELP | 60 |
| SEQ_ID_NO_489 | EKKPLI FDAS VPQHDPNI PQ QFI WPDHEKP NTNL- APELQ | 58 |
| SEQ_ID_NO_490 | DGKSE VFDAS VLRHQSNI PT QFI WPDEEKP ADAD- APELQ | 65 |
| SEQ_ID_NO_491 | VPKPL VFDAS LQHQSNI PS QFV WPDHEKP RAN-- APQLA | 49 |
| SEQ_ID_NO_492 | HQKQL VFDAS MLNLQANI PN QFI WPDDEKP CLD-- SPQLA | 60 |
| SEQ_ID_NO_493 | PQQTL VFDAS | 70 |
| SEQ_ID_NO_495 | IQTPLI FNPS | 60 |

Figure 1C

| SEQ_ID_NO | Sequence | | | | Length |
|---|---|---|---|---|---|
| SEQ_ID_NO_471 | VALIDVGAGA | ----- | ERSSV | VRQVGEACER HGFFLVVNHG | 80 |
| SEQ_ID_NO_473 | VPLIDLSG-- | ----- | DAAEV | VRQVGEACER HGFFQVVNHG | 87 |
| SEQ_ID_NO_475 | VPLIDLSG-- | ----- | DAAEV | VRQVRRACDL HGFFQVVGHG | 78 |
| SEQ_ID_NO_476 | VPLIDLSG-- | ----- | DAAEV | VRQVRRACDL HGFFQVVNHG | 78 |
| SEQ_ID_NO_477 | VPLIDIGGML | SGDPRATAEV | TRLVGEACER | HGFFQVVNHG | 78 |
| SEQ_ID_NO_478 | VPLIDIGGLL | SGDPRAAAEV | TRLVGEACER | HGFFQVVNHG | 78 |
| SEQ_ID_NO_479 | VPLIDIGGML | SGDPRAAAEV | TRLVGEACER | HGFFQVVNHG | 78 |
| SEQ_ID_NO_480 | VPLIDLGGML | SGRSSSTKEA | MRLVGEACQK | HGFFLVVNHG | 102 |
| SEQ_ID_NO_481 | VPLIDLGGFL | SGHSCSTKKA | SKLVGNACQK | HGFFLVVNHG | 98 |
| SEQ_ID_NO_482 | VPLIDLRGFL | SGRPSSAKEA | SNLVGEACQK | HGFFLVVNHG | 97 |
| SEQ_ID_NO_483 | VPLVDLGGFL | SGDSDDPVAAQQA | SLVVGDACRS | HGFFLVVNHG | 94 |
| SEQ_ID_NO_484 | VPLIDLRGFL | SGDPVAAQQA | SKLVGDACRS | HGFFLVTNHG | 100 |
| SEQ_ID_NO_485 | VSLIDLGGFL | SGDPVATMEA | SQLVGDACRK | HGFFLVVNHG | 94 |
| SEQ_ID_NO_487 | VPLIDLGGFL | SGDPAAAMEA | SREISEACQQ | HGFFLVVNHG | 100 |
| SEQ_ID_NO_488 | VPLIDLGGFL | SGDPVAAQQA | TRLVREACQK | HGFFLVVNHG | 100 |
| SEQ_ID_NO_489 | VPLIDLGDFL | SGNPVAAMEA | SRLVGEACRN | HGFFLVVNHG | 98 |
| SEQ_ID_NO_490 | VPLIDLAGFL | SGDPAAALQA | SRLVGEACKK | HGFFLVANHG | 105 |
| SEQ_ID_NO_491 | VPLIDLRGFL | SGDPTAANEA | SRLVGKACQK | HGFFLVVNHG | 89 |
| SEQ_ID_NO_492 | VPLIDLGSFL | SGDHLAVSKA | SSLVGEACKK | HGFFLVVNHG | 100 |
| SEQ_ID_NO_493 | LPPIDLGSFL | S-DPSSTLDA | VELVNEACKK | HGFFLVVNHG | 110 |
| SEQ_ID_NO_495 | VPLIDLQNLL | ---------- | SRLISEACKK | HGFFLVVNHG | 99 |

| SEQ ID | Sequence | Length |
|---|---|---|
| SEQ_ID_NO_471 | EAALLEEAH RCMDAFFTLP LGEKQRAQRR AGESCGYASS | 120 |
| SEQ_ID_NO_473 | DDALLQEAH RCMDAFFTLP MSDKQRAQRR QGDSCGYASS | 127 |
| SEQ_ID_NO_475 | DAALTAEAH RCMDAFFTLP LPDKQRAQRR QGDSCGYASS | 118 |
| SEQ_ID_NO_476 | DAELLADAH RCVDAFFTMP LPEKQRALRR PGESCGYASS | 118 |
| SEQ_ID_NO_477 | DAELLADAH RCVDAFFTMS LQGKQRALRR PGESCGYASS | 118 |
| SEQ_ID_NO_478 | DAQLLADAH RCVDAFFTMP LPEKQRALRR PGESCGYASS | 118 |
| SEQ_ID_NO_479 | DAELLADAH RCVDAFFTMP LPEKQRALRR AGESCGYASS | 118 |
| SEQ_ID_NO_480 | VDANLISDAH TIYMDLFFELP LSEKQRAQRK LGESCGYASS | 142 |
| SEQ_ID_NO_481 | VDENLISDAH QYMDLFFELP LSDKQRAQRK LGEHCGYASS | 138 |
| SEQ_ID_NO_482 | VDASLIADAH RYMDLFFELP LSEKQKAQRK LGEHCGYASS | 137 |
| SEQ_ID_NO_483 | VDANLISNAH RYMDTFFDLP LNEKQRARRK LGEHCGYASS | 134 |
| SEQ_ID_NO_484 | VDAKLIADAH RYMDTFFELP LSEKQRAQRK LGEHCGYASS | 140 |
| SEQ_ID_NO_485 | VDDKLIYKAH KYMDNFLLP LRQKKQRAQRK LGEHCGYASS | 134 |
| SEQ_ID_NO_487 | VNANLISNAH QYMDSFFGLP LAKKQKAQRK LEEHCGYASS | 140 |
| SEQ_ID_NO_488 | VDATLISHAH RYMDMFFDLP LSEKQKAQRK LGESCGYASS | 140 |
| SEQ_ID_NO_489 | AHAHISHAH NYVDTFFKLP LSDKQKAERK AGEHCGYASS | 138 |
| SEQ_ID_NO_490 | VDDKLIAHAH RYMDHFFQLP MSAKQRAQRK VGEHCGYASS | 145 |
| SEQ_ID_NO_491 | VDDKLIAKAH QYIDYFFELP MMVKQRAQRR LGDHCGYASS | 129 |
| SEQ_ID_NO_492 | VDSRLISDAH EYMEMFFSMP LSEKQRVLRK LGDHCGYASS | 140 |
| SEQ_ID_NO_493 | LSEELISDAH EYTSRFFDMP LSEKQRVLRK SGESVGYASS | 150 |
| SEQ_ID_NO_495 | | 139 |

| | | | | | |
|---|---|---|---|---|---|
|SEQ_ID_NO_471|-DRRHYFRRFF|QRNDSIMRLN|YYPACQRPLD|TLGTGPHCDP|237|
|SEQ_ID_NO_473|-GRRHFRRFF|QGNDSIMRLN|YYPPCQRPYD|TLGTGPHCDP|238|
|SEQ_ID_NO_475|-GRRHFRRFF|QGNDSIMRLN|YYPPCQRPYD|TLGTGPHCDP|232|
|SEQ_ID_NO_476|-GRAHYRRFF|EGNDSIMRLN|YYPPCQRPME|TLGTGPHCDP|227|
|SEQ_ID_NO_477|-GRAHYRRFF|EGNDSIMRLN|YYPPCQRPNE|TLGTGPHCDP|227|
|SEQ_ID_NO_478|-GRAHYRRFF|EGNESIMRLN|YYPPCQRPLE|TLGTGPHCDP|227|
|SEQ_ID_NO_479|-GRAHYRRFF|EGNDSIMRLN|YYPPCQRPYE|TLGTGPHCDP|227|
|SEQ_ID_NO_480|-NRSHFKEFF|EENNSIMRLN|YYPRCQKPEL|TLGTGPHCDP|253|
|SEQ_ID_NO_481|-SRAHFKEFF|EENDSIMRLN|YYPRCQKPDQ|TLGTGPHCDP|249|
|SEQ_ID_NO_482|-HRAHFKEFF|EENDSIMRLN|YYPPCQKPEL|TLGTGPHCDP|248|
|SEQ_ID_NO_483|-EKSHFKEFF|EENDSIMRLN|YYPPCQKPEL|TLGTGPHCDP|245|
|SEQ_ID_NO_484|-GRAHFKEFF|EENESIMRLN|YYPPCQKPEL|TLGTGPHCDP|252|
|SEQ_ID_NO_485|-ERSHFKEFF|EENDSIMRLN|YYPPCQKPDL|TLGTGPHCDP|245|
|SEQ_ID_NO_487|-GRAHFREFF|DKNDSIMRLN|YYPPCLKPDL|TLGTGPHCDP|251|
|SEQ_ID_NO_488|-GREHFKEFF|EENDSIMRLN|YYPPCQKPDL|TLGTGPHCDP|251|
|SEQ_ID_NO_489|-SREHFREFF|EENESIMRLN|YYPPCQKPEL|TLGTGPHCDP|249|
|SEQ_ID_NO_490|-SEKHFREFY|NENDSIMRLN|YYPPCQKPDL|TLGTGPHCDP|256|
|SEQ_ID_NO_491|-SQGHYREFF|QENESIMRLN|YYPPCRKPEL|TLGTGPHCDP|240|
|SEQ_ID_NO_492|-GRAYFREFF|EGNDSIMRLN|YYPPCQKPDL|TLGTGPHCDP|251|
|SEQ_ID_NO_493|-KRDYFREFF|EENDSIMRLN|YYPPCTKPDL|TLGTGPHCDP|261|
|SEQ_ID_NO_495| | | | |250|

Figure 1G

| SEQ_ID_NO | | | | | | |
|---|---|---|---|---|---|---|
| SEQ_ID_NO_471 | TSLTI | LHQDH | VGGLEVWA- | ---- | EGRWRA | IRPRPGAL | VV | 271 |
| SEQ_ID_NO_473 | TSLTI | LHQDD | VGGLQVFDAA | TGPGT | GRWRS | IRPHPGAF | VV | 278 |
| SEQ_ID_NO_475 | TSLTI | LHQDD | VGGLQVFDAA | ---- | TLAMRS | IRPRPGAF | VV | 268 |
| SEQ_ID_NO_476 | TSLTI | LHQDD | VGGLQVHT- | ---- | EGRWRS | IRPRADAF | VV | 261 |
| SEQ_ID_NO_477 | TSLTI | LHQDN | VGGLQVHT- | ---- | DGRWLS | IRPRADAF | VV | 261 |
| SEQ_ID_NO_478 | TSLTI | LHQDD | VGGLQVHT- | ---- | DGRWRS | IRPRADAF | VV | 261 |
| SEQ_ID_NO_479 | TSLTI | LHQDN | VGGLEVFI- | ---- | DNEWRS | ITPNSNAF | VV | 287 |
| SEQ_ID_NO_480 | TSLTI | LHQDD | VGGLEVFV- | ---- | DNEWRS | IAPNSQAF | VV | 283 |
| SEQ_ID_NO_481 | TSLTI | LHQDS | VGGLQVFV- | ---- | DNEWRS | IAPNSNAF | VV | 282 |
| SEQ_ID_NO_482 | TSLTI | LHQDC | VGGLQVFV- | ---- | DNEWRS | ITPTTFNAF | VV | 279 |
| SEQ_ID_NO_483 | TSLTI | LHQDD | VGGLQVFV- | ---- | DNEWRS | ISPNFEAF | VV | 286 |
| SEQ_ID_NO_484 | TSLTI | LHQDR | VGGLQVFV- | ---- | DNEWRS | ISPNFDAF | VV | 279 |
| SEQ_ID_NO_485 | TSLTI | LHQDQ | VGGLQVFV- | ---- | DDKWMS | ISPNFNAF | VV | 285 |
| SEQ_ID_NO_487 | TSLTI | LHQDS | VGGLQVFV- | ---- | DNEWRS | ISPNFNAF | VV | 285 |
| SEQ_ID_NO_488 | TSLTI | LHQDQ | VGGLQVFV- | ---- | DNQWRS | INPNFDAF | VV | 283 |
| SEQ_ID_NO_489 | TSLTI | LHQDT | VGGLQVFV- | ---- | DEEWRS | IPPNFNAF | VV | 290 |
| SEQ_ID_NO_490 | TSLTI | LHQDQ | VGGLQVFV- | ---- | DEKWHS | ITPNFNAF | VV | 274 |
| SEQ_ID_NO_491 | TSLTI | LHQDE | VGGLQVFV- | ---- | DEEWRS | VHPDPQAF | VV | 285 |
| SEQ_ID_NO_492 | TSLTI | LHQDH | VNGLQVFV- | ---- | ENQWRS | IRPNPKAEV | VV | 295 |
| SEQ_ID_NO_493 | | | | | | | | |
| SEQ_ID_NO_495 | | | | | | | | 284 |

| SEQ_ID | | | | | |
|---|---|---|---|---|---|
| SEQ_ID_NO_471 | NV GDTF MALS | NARYRSCLHR | AVVNSTAPRR | SLAFFLCPEM | 311 |
| SEQ_ID_NO_473 | NI GDTF MALS | NGRYRSCLHR | AVVNSRVPRR | SLAFFLCPEM | 318 |
| SEQ_ID_NO_475 | NI GDTF MALS | NGRYRSCLHR | AVVNSRVARR | SLAFFLCPEM | 308 |
| SEQ_ID_NO_476 | NI GDTF MALS | NGRYKSCLHR | AVVNSKVPRK | SLAFFLCPEM | 301 |
| SEQ_ID_NO_477 | NI GDTF MALS | NGRYRSCLHR | AVVNSRVPRK | SLAFFLCPEM | 301 |
| SEQ_ID_NO_478 | NI GDTF MALS | NGRYRSCLHR | AVVNSRVPRK | SLAFFLCPEM | 301 |
| SEQ_ID_NO_479 | NI GDTF MALS | NGRYRSCLHR | AVVNSRVPRK | SLAFFLCPEM | 301 |
| SEQ_ID_NO_480 | NI GDTF MALS | NGRYKSCLHR | AVVNSKTPRK | SLAFFLCPKK | 327 |
| SEQ_ID_NO_481 | NI GDTF MALS | NGRYKSCLHR | AVVNNRLHRK | SLAFFLCPKK | 323 |
| SEQ_ID_NO_482 | NI GDTF MALS | NGRYKSCLHR | AVVNNKTPRK | SLAFFLCPKK | 322 |
| SEQ_ID_NO_483 | NI GDTF MALS | NGRYKSCLHR | AVVNSQTPRK | SLAFFLCPKN | 319 |
| SEQ_ID_NO_484 | NI GDTF MALS | NGRYKSCLHR | AVVNNKIPRK | SLAFFLCPKN | 326 |
| SEQ_ID_NO_485 | NI GDTF MALS | NGRYKSCLHR | AVVNSHKPRK | SLAFFLCPEG | 319 |
| SEQ_ID_NO_487 | NI GDTF MALS | NGRYKSCLHQ | AVVNSQTPRK | SLAFFLCPEK | 325 |
| SEQ_ID_NO_488 | NI GDTF MALS | NGRYKSCLHR | AVVNSQTPRK | SLAFFLCPKK | 325 |
| SEQ_ID_NO_489 | NI GDTF MALS | NGIYRSCLHR | AVVNSQTPRK | SLAFFLCPKN | 323 |
| SEQ_ID_NO_490 | NI GDTF MALS | NGKYKSCLHR | AVVNSKSPRK | SLAFFLCPKN | 330 |
| SEQ_ID_NO_491 | NI GET LMALS | NGIFKSCLHR | AVVNNRTVRK | SLAFFLCPKN | 314 |
| SEQ_ID_NO_492 | NI GDTF MALS | NDRYKSCLHR | AVVNSESERK | SLAFFLCPKK | 325 |
| SEQ_ID_NO_493 | NI GDTF MALS | NGRYKSCLHR | AVVNSKSPRK | SLAFFLCPNM | 335 |
| SEQ_ID_NO_495 | NI GDTF MALS | NGRYKSCLHR | AVVNSESERK | SLAFFLCPKK | 324 |

| SEQ ID | Sequence | Pos |
|---|---|---|
| SEQ_ID_NO_471 | DLVRPPEEL VDD- HHPRVY PDFTWRALLD FTQRHYRADM | 350 |
| SEQ_ID_NO_473 | DKVVRPPAEL VDD- ANPRAY PDFTWRTLLD FTMRHYRSDM | 357 |
| SEQ_ID_NO_475 | DKVVRPPKEL VDD- ANPRAY PDFTWRTLLD FTMRHYRSDM | 347 |
| SEQ_ID_NO_476 | DKVVAPPGTL VDA- ANPRAY PDFTWRSLLD FTQKHYRADM | 340 |
| SEQ_ID_NO_477 | DKVVAPPETL VDA- ANPRAY PDFTWRALLD FTQKHYRADM | 340 |
| SEQ_ID_NO_478 | DKVVAPPGTL VDA- ANPRAY PDFTWRALLD FTQKHYRADM | 340 |
| SEQ_ID_NO_479 | DKVVAPPGTL VDE- ANPRAY PDFTWRSLLD FTQKHYRADM | 340 |
| SEQ_ID_NO_480 | DKVVSPPKEL VDE- NNPRVY PDFTWATFLE FTQKHYRADM | 366 |
| SEQ_ID_NO_481 | DKVVSPPEKL VDQ- KNPRIY PDFTWSTFLE FTQKHYRADM | 362 |
| SEQ_ID_NO_482 | DKVVSPPPEL VDE- NNPRIY PDFTWSTFLE FTQKHYRADM | 361 |
| SEQ_ID_NO_483 | DKVVSPPNEL VDTY SSPRIY PDFTWPTLLE FTQKHYRADM | 358 |
| SEQ_ID_NO_484 | DKVVSPPSEL VDS- NNPRMY PDFTWPMLLE FTQKHYRADM | 366 |
| SEQ_ID_NO_485 | DKVVSPPSKL VSQ- NSPRIY PDFTWPTLHE FTQKHYRADM | 358 |
| SEQ_ID_NO_487 | DKVVRPPAEL VDT- NSPRIY PDFTWSNLLE FTQKHYRADM | 364 |
| SEQ_ID_NO_488 | DKVVSPPTEL VDT- NNPRIY PDFTWPTLLE FTQKHYRADM | 364 |
| SEQ_ID_NO_489 | DKMVTPPHEL VDT- QNPRIY PDFTWPMLLE FTQKHYRADM | 362 |
| SEQ_ID_NO_490 | DKVVRPPNEL VDS- SNPRVY PDFTWPTLLE FTQKHYRADM | 369 |
| SEQ_ID_NO_491 | DKVVSPPSEL VDS- LQPRVY PDFTWPMLLE FTQKHYRADM | 353 |
| SEQ_ID_NO_492 | DKVVKPPKNL VDS- NNPRLY PDFTWPALLE FTQKYYRADM | 364 |
| SEQ_ID_NO_493 | EKVVKPPKNL VDS- NNPRLY PDFTWPALLE FTQKYYRADV | 374 |
| SEQ_ID_NO_495 | DRVVTPPREL LDS- ITSRRY PDFTWSMFLE ETQKHYRADM | 363 |

Figure 1J

| SEQ_ID_NO_99 | MAGSDEVNRN | ECKTVVPLHT | WWLISNFKLS | YNILRRADGT | 40 |
|---|---|---|---|---|---|
| SEQ_ID_NO_101 | MAGSDEVNRN | ECKTAVPIHT | WWLISNFKLA | YNMLRRADGT | 40 |
| SEQ_ID_NO_103 | MAGSDEVNRN | ECKGAVPIHT | WWLISNFKLA | YNMLRRADGT | 40 |
| SEQ_ID_NO_104 | MAGSDEVNRN | ECKTVVPLHT | WWLISNFKVS | YHMLRRADGT | 40 |
| SEQ_ID_NO_105 | MAGSDEVNRN | ECKGAVPIHT | WWLISNFKLA | YNMLRRADGT | 40 |
| SEQ_ID_NO_106 | MAGSDEVNRN | ECKGAVPIHT | WWLISNFKVS | YHMLRRPDGT | 40 |
| SEQ_ID_NO_107 | MAGSDEVNRN | ECKMVVPLNT | WWLISNFKLA | YNMLRRPDGT | 40 |
| SEQ_ID_NO_108 | MARSNEVNLN | ESKRVVPLNT | WWLISNFKLA | YNLLRRPDGT | 40 |
| SEQ_ID_NO_110 | MAGSNGVNLN | ESKMVVPLNT | WWLISNFKLA | YNLLRRPDGT | 40 |
| SEQ_ID_NO_111 | MAGSDEVNLN | ESKRVVPLNT | WWLISNFKLA | YNLLRRPDGT | 40 |
| SEQ_ID_NO_112 | MAGSDEVNHH | ECKRIVPLNT | WLISNFKLA | YNLLRRPDGS | 40 |
| SEQ_ID_NO_113 | MAGSNEVNLN | ESKRVVPLNT | WWLISNFKLA | YTLLRRPDGT | 40 |
| SEQ_ID_NO_114 | MAGSNEVNLN | ESKRVVPLNT | WWLISNFKLA | YTILRRSDGT | 40 |
| SEQ_ID_NO_115 | MAGSNEINVN | ESKKVVPLNT | WLISNFKLA | YNMLRRPDGT | 40 |

| SEQ_ID_NO_99 | FERDLGEYLD | RRVPANARPL | EGVSSFDHI | DQSVGLEVRI | 80 |
|---|---|---|---|---|---|
| SEQ_ID_NO_101 | FDRDLAEYLD | RRVPPDARAQ | EGVSSFDHVI | DPSVGLEVRI | 80 |
| SEQ_ID_NO_103 | FDRDLAEFLD | RRVPPDARAQ | EGVSSFDHVI | DISTGLEVRI | 80 |
| SEQ_ID_NO_104 | FDRDLAEYMD | RRVPANPKPV | EGVSSFDHVI | DHSVGLEARI | 80 |
| SEQ_ID_NO_105 | FDRDLAEFLD | RRVPANPRPV | EGVSSFDHVI | DTSTGLEVRI | 80 |
| SEQ_ID_NO_106 | FDRDLAEFLD | RRVPPDARAQ | EGVSSEDHFI | DLSVGLEARI | 80 |
| SEQ_ID_NO_107 | FDRDLAEFLD | RRVPANANPV | EGVSSDHVI | DTSTGLEVRI | 80 |
| SEQ_ID_NO_108 | FNRHLAEFLD | RKVPANANPV | DGVFSFDVLI | DRGTSLLSRI | 80 |
| SEQ_ID_NO_110 | FNRHLAEFLD | RKVPPNANPV | DGVFSFDVII | DRGTSLLSRI | 79 |
| SEQ_ID_NO_111 | FERELAEFLE | RKAPANSFPV | DGVFSFDL-V | DKTTGLLNRV | 79 |
| SEQ_ID_NO_112 | FNRDLAEFLD | RKVPANSFPV | DGVFSFDHL-V | DTSTSLLTRI | 79 |
| SEQ_ID_NO_113 | FNRELAEYLE | RKVPANVNPV | DGVFSFDNV | DRASGLLNRV | 79 |
| SEQ_ID_NO_114 | FNRDLAEFLE | RKVPPNAIPV | DGVFSEDVIV | DSISLLNRI | 79 |

| SEQ_ID_NO | | | | | | |
|---|---|---|---|---|---|---|
| SEQ_ID_NO_99 | EHRYPCAYDD | GWTALKWMS | QPFMRSGG-- | DAQARVFLSG | 196 |
| SEQ_ID_NO_101 | EHRYPCAYDD | GWAALKWAMS | QPFLRSGE-- | GAQPRVFLSG | 198 |
| SEQ_ID_NO_103 | EHRYPCAYDD | GWTALKWAMS | QPFLRSGRGG | DARPRVFLSG | 199 |
| SEQ_ID_NO_104 | EHRYPCAYDD | GWAALKWAQA | QPFLRSGE-- | DAQPRVFLAG | 197 |
| SEQ_ID_NO_105 | EHRYPCAYDD | GWAALKWAMS | QPFLRSGA-- | DARLRVFLSG | 197 |
| SEQ_ID_NO_106 | EHRYPCAYDD | GWAALKWAQA | QPFLRSGS-- | DGRPRVFLAG | 198 |
| SEQ_ID_NO_107 | ENRYPCAYDD | GWTALKWNS- | RPWLQSGG-- | DSKVHIYLAG | 193 |
| SEQ_ID_NO_108 | ENRYPCAYDD | GWTALKWNS- | RTWLQSKK-- | DSKVHIYLAG | 188 |
| SEQ_ID_NO_110 | EHRYPCAYDD | GWAALKWNS- | RSMLQSQK-- | DAKVHMYLAG | 188 |
| SEQ_ID_NO_111 | ENRYPCAYDD | GWTALKWKS- | RVMLQSGK-- | DSKVHVYLAG | 188 |
| SEQ_ID_NO_112 | ENRYPCAYDD | GWAALKWKS- | KKMLQSGK-- | DSNVYYLAG | 188 |
| SEQ_ID_NO_113 | EHRYPCAYDD | GWNALKWKS- | KKWLQSGK-- | DSKVHVYLAG | 188 |
| SEQ_ID_NO_114 | EFRYPCAYED | GWTALKWWHS | RPWLHSGK-- | DSKAYVYLAG | 190 |
| SEQ_ID_NO_115 | ENRYPSAYDD | | | | |

| SEQ_ID_NO | | | | | | |
|---|---|---|---|---|---|---|
| SEQ_ID_NO_99 | DSSGGNIAHH | VAVRAADEGV | KVCGNILLNA | MFGGTERTES | 236 |
| SEQ_ID_NO_101 | DSSGGNIAHH | VAVRAADAGI | RICGNILLNA | MFGGTERTDS | 238 |
| SEQ_ID_NO_103 | DSSGGNIAHH | VAVRAADAGI | NICGNILLNA | MFGGTERTES | 239 |
| SEQ_ID_NO_104 | DSSGGNIAHH | VAVRAADAGI | KIHGNILLNA | MFGGKERTES | 237 |
| SEQ_ID_NO_105 | DSSGGNIAHH | VAVRAAEEGI | SICGNILLNA | MFGGVERTES | 237 |
| SEQ_ID_NO_106 | DSSGGNIAHH | VAVRAADAGI | KINGNILLNP | MFGGTERTES | 238 |
| SEQ_ID_NO_107 | DSSGGNIAHH | VALRAIESGI | DILGSILLNP | MFGGTERTES | 233 |
| SEQ_ID_NO_108 | DSSGGNIAHH | VALRAVESGI | DVLGNILLHP | MFGGQERTES | 228 |
| SEQ_ID_NO_110 | DSSGGNIVHH | VALRALESGI | EVLGNILLHP | MFGGQERTES | 228 |
| SEQ_ID_NO_111 | DSSGGNITHH | VAVRAINEGV | KVLGNILLHP | MFGGLERTQS | 228 |
| SEQ_ID_NO_112 | DSSGGNIAHH | VAARAAEED- | EVLGNILLHP | MFGGEKRTES | 228 |
| SEQ_ID_NO_113 | DSSGGTLAHH | VAHRAAESGV | EVLGNILLHP | MEGGQERTES | 230 |

| SEQ_ID_NO | | | | | | |
|---|---|---|---|---|---|---|
| SEQ_ID_NO_99 | ERRLDGKYFV | TLQDRDWYWK | AYLPEDADRD | HPACNPFGPN | 276 |
| SEQ_ID_NO_101 | ERRLDGKYFV | TLQDRDWYWK | AYLPEDADRD | HPACNPFGPN | 278 |
| SEQ_ID_NO_103 | ERRLDGKYFV | TLQDRDWYWK | AYLPEDADRD | HPACNPFGPN | 279 |
| SEQ_ID_NO_104 | ERRLDGKYFV | TLQDRDWYWK | AYLPEDADRD | HPACNPFGPN | 277 |
| SEQ_ID_NO_105 | ERRLDGKYFV | TMQDRDWYWK | AYLPEDTDRD | HPACNPFGPN | 277 |
| SEQ_ID_NO_106 | ERRLDGKYFV | TLQDRDWYWK | AYLPEDADRD | HPACNPFGPN | 278 |
| SEQ_ID_NO_107 | ERRLDGKYFV | TLRDRDWYWR | AYLPEGEDRD | HPACNPFGPN | 273 |
| SEQ_ID_NO_108 | EKRLDGKYFV | TLQDRDWYWR | AFLPEREDRD | HPACNPFGPK | 268 |
| SEQ_ID_NO_110 | EKRLDGKYFV | TLQDRDWYWR | AFLPEEADRD | HPACNPFGPK | 268 |
| SEQ_ID_NO_111 | EKRLDGKYFV | TVQDRDWYWK | AYLPEGEDRD | HPACNPFGPK | 268 |
| SEQ_ID_NO_112 | EKRLDGKYFV | TI-QDRDWYWK | AYLPEGEDRD | HPACNPFGPR | 268 |
| SEQ_ID_NO_113 | EKKLDGKYFV | TI-HDRDWYWK | AYLPEGEDRD | HPACNPFGPK | 268 |
| SEQ_ID_NO_114 | EKKLDGKYFV | TI-QDRDWYWK | AYLPEGEDRD | HPACNPFGPK | 268 |
| SEQ_ID_NO_115 | EKKLDGKYFV | TI-QDRDWYWR | AYLPEGEDRD | HPACNPFGPR | 270 |

| SEQ_ID_NO | | | | | | |
|---|---|---|---|---|---|---|
| SEQ_ID_NO_99 | GRRLGGLPFFA | KSLIIVSGLD | LTCDRQLAYA | DALREDGHHV | 316 |
| SEQ_ID_NO_101 | GRRLRGLPFFT | KSLIIVSGLD | LTCDRQLAYA | EGLREDGHHV | 318 |
| SEQ_ID_NO_103 | GRRLRGLPFFT | KSLIIVSGLD | LTCDRQLAYA | EGLREDGHHA | 319 |
| SEQ_ID_NO_104 | GRRLRGLPFFA | KSLIIVSGLD | LTCDRQLAYA | EGLQEDGHHV | 317 |
| SEQ_ID_NO_105 | GRRLRGLPFFT | KSLIIVSGLD | LTCDRQLGYA | EGLREDGHHV | 317 |
| SEQ_ID_NO_106 | GRRLRGLPFFA | KSLIIVSGLD | LTCDRQLGYA | EGLREDGHDV | 318 |
| SEQ_ID_NO_107 | GRRLRGLPFPP | KSLIIVSGLD | LTCDRQLAYA | EGLQQDGHHV | 313 |
| SEQ_ID_NO_108 | GRSLEGIKFFP | KSLVVVAGLD | LVHDRQIAYA | EGLKKAGQEV | 308 |
| SEQ_ID_NO_110 | GRSLEGMKFFP | KSLVVVAGLD | LQDWQLAYV | EGLKKAGQDV | 308 |
| SEQ_ID_NO_111 | GKSLEGLNFFP | KSLVVVAGLD | LQDWQLAYV | EGLKKAGQVV | 308 |
| SEQ_ID_NO_112 | GKSLEGVNFP | KSLVVVAGED | LVQDWQLAYV | DGLKRTGHHV | 308 |
| SEQ_ID_NO_113 | GQSLEGIKFP | KSLVVVAGLD | LVQDWQLAYV | QGLKNSGHDV | 308 |
| SEQ_ID_NO_114 | AKSLEGINFP | KSLVVVAGLD | LMQDWQLAYV | EGLKNAGQEV | 308 |
| SEQ_ID_NO_115 | GVSLEGLSFP | KSLVVVAGLD | LVQDWQLAYV | EGLKNAGQEV | 310 |

Figure 2D

| SEQ_ID_NO | | | | | |
|---|---|---|---|---|---|
| SEQ_ID_NO_99 | KVVQCENATV | GFYLLPNTVH | YHEVMEEISD | FLNA- | 350 |
| SEQ_ID_NO_101 | KLVYREKATI | GFYLLPNTDH | YHEVMEEISD | FLGA- | 352 |
| SEQ_ID_NO_103 | KLVYREKATI | GFYLLPNTDH | YHEVMEEIAD | FLRA- | 353 |
| SEQ_ID_NO_104 | KVVHREKATI | GFYLLSNTDH | YHEVMEEIAD | FVQL- | 351 |
| SEQ_ID_NO_105 | KLVYREKATI | GFYLLSNTDH | YHEVMEEIAD | FLRA- | 351 |
| SEQ_ID_NO_106 | KLVYHREKATI | GFYLLSNTNH | YHEVMEEIAE | FVRA- | 352 |
| SEQ_ID_NO_107 | KVVYREKATV | GFYLLSNTDH | YHEVMEEIAE | FLAA- | 347 |
| SEQ_ID_NO_108 | KLLYVEQATI | GFYLLPNNNY | YHEVMEEISK | FVSS- | 342 |
| SEQ_ID_NO_110 | KLLYLEQATI | GFYLLPNNNH | FHTVMDEISE | FVSP- | 342 |
| SEQ_ID_NO_111 | KLLYLEQATI | GFYLLPNNDH | FHTVMDEISE | FVCP- | 342 |
| SEQ_ID_NO_112 | NLLFLEQATI | GFYFLPNNDH | FYCLMEEISK | FVKS-DEDSQ | 348 |
| SEQ_ID_NO_113 | NLLYLEQATI | GFYFLPNNDH | FHCLMDELTK | FVHS- | 342 |
| SEQ_ID_NO_114 | KLLFLEQATI | GFYFLPNNEH | FYCLMEEIDN | FIN-- | 341 |
| SEQ_ID_NO_115 | KLLFLKQATI | GFYFLPNNDH | EYYLMEEINS | EVNP- | 344 |

| SEQ_ID_NO | | | |
|---|---|---|---|
| SEQ_ID_NO_99 | -----NL---- | YY | 354 |
| SEQ_ID_NO_101 | -----NL---- | -L | 355 |
| SEQ_ID_NO_103 | -----NL---- | -R | 355 |
| SEQ_ID_NO_104 | -----NL---- | -L | 354 |
| SEQ_ID_NO_105 | -----NL---- | -L | 353 |
| SEQ_ID_NO_106 | -----NL---- | -Q | 355 |
| SEQ_ID_NO_107 | -----DI---- | -Q | 349 |
| SEQ_ID_NO_108 | -----N----- | -Q | 344 |
| SEQ_ID_NO_110 | -----N----- | -Q | 344 |
| SEQ_ID_NO_111 | -----N----- | -C | 344 |
| SEQ_ID_NO_112 | SKSSPVLLT- | -P | 358 |
| SEQ_ID_NO_113 | ---------- | -P | 342 |
| SEQ_ID_NO_114 | -----N---- | -Q | 346 |

| SEQ ID NO | | | | | | | |
|---|---|---|---|---|---|---|---|
| SEQ_ID_NO_188 | MKREYQEAGG | SSGGG---- | ------- | --SS- | -ADM | G--- | SCKDKVMA | 29 |
| SEQ_ID_NO_221 | MKREYQEAGG | SSGGG---- | ------- | --SS- | -ADM | G--- | SCKDKVMA | 29 |
| SEQ_ID_NO_201 | MKREYQDAGG | SGG------ | ------- | ----- | --DM | G--- | SSKDKMMA | 24 |
| SEQ_ID_NO_194 | MKREYQDAGG | SGG------ | ------- | ----- | --DM | G--- | SSKDKMMA | 24 |
| SEQ_ID_NO_215 | MKREYQDAGG | SGG------ | ------- | ----- | -DM | G--- | SSKDKMMA | 24 |
| SEQ_ID_NO_202 | MKREYQDAGG | SGGGG---- | ------- | ----- | --DM | G--- | SSRDKMMV | 27 |
| SEQ_ID_NO_207 | MKREYQDAGG | SGGGG---- | ------- | --EM | G--- | SSKDKMMV | 24 |
| SEQ_ID_NO_283 | MKREYQDAGG | SGGGG---- | ------- | ----- | --DM | G--- | SSKDKMMV | 27 |
| SEQ_ID_NO_196 | MKRDLLDGCG | GGGGG---- | ---GGGK | GEEG- | SSM | V--- | SAKGKMWD | 36 |
| SEQ_ID_NO_235 | MKRDHQETIG | GAGNSI | GNKA | ESSS- | SSM | A--- | TGKGKLW | 36 |
| SEQ_ID_NO_245 | MKRDFQQACA | GGPV----- | -----K | G-DS | SSM | P--- | NGKAKMWE | 30 |
| SEQ_ID_NO_286 | MKRDHRDSRA | TVTARENNSK | PEYSsPPS | SA-L- | PSNGKAKIWE | 39 |
| SEQ_ID_NO_282 | MKRDHRDSCG | GGGG----- | ------- | GEC- | SSM | S--- | NGKANMWE | 34 |
| SEQ_ID_NO_239 | MKREHQESKG | DSS------ | ------- | ----- | SCS | A--- | MAKGKLWQ | 26 |
| SEQ_ID_NO_277 | MKRDRDRDRE | REKR----- | ------- | AFSN- | GAV | S--- | SGKSKIWE | 30 |

| SEQ ID NO | | | | | | | |
|---|---|---|---|---|---|---|---|
| SEQ_ID_NO_188 | GAA----- | ------- | EEEDVDELLA | ALGYKVRSSD | MADVAQKLEQ | 63 |
| SEQ_ID_NO_221 | GAA----G- | ------- | EEEDVDELLA | ALGYKVRSSD | MADVAQKLEQ | 63 |
| SEQ_ID_NO_201 | AAA----G- | ---EQ | QDEEVDELLA | ALGYKVRSSD | MADVAQKLEQ | 59 |
| SEQ_ID_NO_194 | AAAGAG--- | ------- | EEEDVDELLA | SLGYKVRSSD | MADVAQKLEQ | 62 |
| SEQ_ID_NO_215 | AAAGAG--- | ------- | QEEEVDELLA | ALGYKVRASD | MADVAQKLEQ | 61 |
| SEQ_ID_NO_202 | SSSEAG--- | ------E | EGEEVDELMA | AVGYKVRSSD | MADVAQKLEQ | 63 |
| SEQ_ID_NO_207 | AAAGAG--- | ------- | QEEEMDELLA | VLGYKVRSSD | MADVAQKLEQ | 61 |
| SEQ_ID_NO_283 | SAA----AG | ------- | EGEEVDELLA | VLGYNRSSE | MADVAQKLEQ | 62 |
| SEQ_ID_NO_196 | DIG----Q- | ------- | QDAGMDELLA | VLGYKISSE | MVDVAQKLEQ | 70 |
| SEQ_ID_NO_235 | EDD----- | ---RH- | DIAGMDELLA | VLGYKVRASD | MADVAQKLEQ | 70 |
| SEQ_ID_NO_245 | EDL----Y S- | ------- | AIGGDMDELLA | ALGYKVRSSD | MADVAQKLEQ | 65 |
| SEQ_ID_NO_286 | DDQ----DG | ------Y- | QGQGMDELLA | VLGYKVRSSD | MAEVAQKLEQ | 76 |
| SEQ_ID_NO_282 | EEE----QQ | ------- | QQQGMDELLA | VLGYKVRSSD | MAEVAQKLEQ | 68 |
| SEQ_ID_NO_239 | EEE----QQ | ------- | DGGMDELLA | VLGYKVRSSD | MADVAQKLEQ | 64 |
| SEQ_ID_NO_277 | EDE----E- | -EK- | PDAGMDELLA | VLGYKVKSSD | MADVAQKLEQ | 66 |

Figure 3A

| SEQ_ID_NO_188 | LEMAMGMGGV | SAP-GAADDG | FVSHLATDTV | HYNPSDLSSW | 102 |
|---|---|---|---|---|---|
| SEQ_ID_NO_221 | LEMAMGMAGV | SAP-GAADDG | FVSHLATDTV | HYNPSDLSSW | 102 |
| SEQ_ID_NO_201 | LEMAMGMGGV | GGAATAVDDG | FVSHLATDTV | HYNPSNLSSW | 99 |
| SEQ_ID_NO_194 | LEMAMGMGGV | GGAGATADDG | FVSHLATDTV | HYNPSDLSSW | 102 |
| SEQ_ID_NO_215 | LEMAMGMGGV | GGAGATADDG | FISHLATDTV | HYNPTDLSSW | 101 |
| SEQ_ID_NO_202 | LEMAMGMGGL | ---PAPDDG | FATHLATDTV | HYNPSDLSSW | 98 |
| SEQ_ID_NO_207 | LEMAMGMGGV | GGAGATADDG | FATHLATDTV | HYNPTDLSSW | 101 |
| SEQ_ID_NO_283 | LEMAMGMGGV | GAF-GAAPDDS | ---------- | HYNPSDLSSW | 101 |
| SEQ_ID_NO_196 | LEMVMGN--- | -AQEDG | ISHLSSGTV | HYNPSDLSGW | 101 |
| SEQ_ID_NO_235 | LEMVLGS--- | EDG | SHLASDTV | HYNPSDLSGW | 99 |
| SEQ_ID_NO_245 | LEMVMGS--- | AQEEDG | SHLSSMTV | HYDPTDLSGW | 96 |
| SEQ_ID_NO_286 | LEMVMGS--- | AQEEDG | SQL-SDTV | HYNPSDLSGW | 106 |
| SEQ_ID_NO_282 | LEMVMGC--- | AQEEDG | SHLASDTV | HYDPTDLYSW | 99 |
| SEQ_ID_NO_239 | LEMVMGL--- | AQEDG | SHL-SDTV | HYNPSDLSGW | 94 |
| SEQ_ID_NO_277 | LEMAMGT--- | TMEDG | THLSTDTV | HKNPSDMAGW | 97 |

| SEQ_ID_NO_188 | VESMLSELNA | PLPP-IPP- | -------A-P- | PAARHASTS | 130 |
|---|---|---|---|---|---|
| SEQ_ID_NO_221 | VESMLSELNA | PLPP-IPP- | -------A-P- | PAARHASTS | 130 |
| SEQ_ID_NO_201 | VESMLSELNA | PPPPLPT- | -------A-P- | PAPRLASTS | 127 |
| SEQ_ID_NO_194 | VESMLSELNA | PPAPLPP- | -------A-P- | PAPRLASTS | 130 |
| SEQ_ID_NO_215 | VESMLSELNA | PPPPLPP- | -------A-T- | PAPRLASTS | 131 |
| SEQ_ID_NO_202 | LESMLSELNA | PPPPLPP- | -------A-P- | PAPLNASTS | 125 |
| SEQ_ID_NO_207 | VESMLSELNA | PPPPLPP- | -------A-P- | APRLASTS | 123 |
| SEQ_ID_NO_283 | VESMLTELNP | PPPPLPP- | -------A-P- | -Q-FLNASTS | 127 |
| SEQ_ID_NO_196 | VESMLSELNP | PSSA-FASSS | QQTPILDDP-T | ----APSES | 135 |
| SEQ_ID_NO_235 | VQSMLSELNP | LPSSDLDS- | -------S-T- | LSNNQDSNP | 129 |
| SEQ_ID_NO_245 | VQSMLSELNT | EPIIT---- | ---------- | ----DPS | 115 |
| SEQ_ID_NO_286 | VQSMLSELNP | GDDM-P--- | SILDDP | -LL-APAES | 133 |
| SEQ_ID_NO_282 | VQTMLTELNP | EPNN-NNN- | ---------- | LL-GPS | 122 |
| SEQ_ID_NO_239 | VQSMLSELNN | PLDT-LQN- | -------S-P- | LL-QQDSS | 116 |
| SEQ_ID_NO_277 | VQSMLSLST- | NFDM-QN-- | ---------- | QEN | 116 |

| SEQ_ID_NO | | | | | | | |
|---|---|---|---|---|---|---|---|
| SEQ_ID_NO_188 | GGGASRGSVV | EAAPP---- | ---------- | ----ATQ--- | GAAAANAPAV | 227 |
| SEQ_ID_NO_221 | GGGASRGSVV | EAAPP---- | ---------- | ----AMQ--- | GAAAANAPAV | 227 |
| SEQ_ID_NO_201 | DGGRTRSSVV | EAAPP---- | ---------- | ----ATQ--- | ASAAANAPAV | 225 |
| SEQ_ID_NO_194 | DGGRTRSSVV | EAAPP---- | ---------- | ----ATQ--- | ASAAANGPAV | 229 |
| SEQ_ID_NO_215 | GGGAARSSVV | EAAPP---- | ---------- | ----ATQ--- | APAAAAPAL | 231 |
| SEQ_ID_NO_202 | DGGRTRSSVV | EAAPP---- | ---------- | ----VAL--- | -AAAAAPAL | 216 |
| SEQ_ID_NO_207 | GGGARSSVV | EAAPP---- | ---------- | ----ATQ--- | ASAAANGPAV | 222 |
| SEQ_ID_NO_283 | GGGFARSSVV | EAAPP---- | ---------- | ----VAL--- | -AAANATPAL | 220 |
| SEQ_ID_NO_196 | QSSNS-SCTP | SSSPQ---- | ---------- | ----EN---- | GLASVAESTR | 217 |
| SEQ_ID_NO_235 | TVATTNLQTV | EELEPG--TN | ---------- | ----AIMA-- | VSGTLSEPTR | 223 |
| SEQ_ID_NO_245 | ---------- | ---------- | ---------- | KRLKASPIE- | SSESASEPTR | 212 |
| SEQ_ID_NO_286 | ---------- | DELE-TANNI | N--------- | ---------- | -GAVSDPTR | 204 |
| SEQ_ID_NO_282 | NNNL------ | ---------- | ---------- | KRLKPSPVE- | SADSASEPTR | 195 |
| SEQ_ID_NO_239 | ---------- | ---------- | ---------- | ---------- | PTNLSEPNR | 186 |
| SEQ_ID_NO_277 | ---------- | ---------- | ---------- | ---------- | MVTDSSATR | 185 |
| SEQ_ID_NO_188 | PVVVVDTQEA | GIRLVHALLA | CAEAVQQENF | AAAEALVKQI | 267 |
| SEQ_ID_NO_221 | PVVVVDTQEA | GIRLVHALLA | CAEAVQQENF | AAAEALVKQI | 267 |
| SEQ_ID_NO_201 | PVVVVDTQEA | GIRLVHALLA | CAEAVQQENF | AAAEALVKQI | 265 |
| SEQ_ID_NO_194 | PVVVVDTQEA | GIRLVHALLA | CAEAVQQENF | TAAEALVKQI | 269 |
| SEQ_ID_NO_215 | PVVVVDTQEA | GIRLVHALLA | CAEAVQQENF | SAAEALVKQI | 271 |
| SEQ_ID_NO_202 | PVVVMDTQEA | GIRLVHALLA | CAEAVQQENL | SAADALVKQI | 256 |
| SEQ_ID_NO_207 | PVVVVDTQEA | GIRLVHALLA | CAEAVQQENL | SAADALVKQI | 262 |
| SEQ_ID_NO_283 | PVVVMDTPEA | GIRLVHALLA | CADAVQQDNM | SAADALVKHV | 260 |
| SEQ_ID_NO_196 | PVVVVDTQEA | GIRLVHALLA | CAEAIQQENL | SAADALVKHV | 257 |
| SEQ_ID_NO_235 | PVVLIDSQEA | GVRLVHTLLA | CAEAVQQENL | KLADALVKHI | 263 |
| SEQ_ID_NO_245 | PVVLVDSQEA | GVRLVHTLMA | CAEAVQQENL | KLADALVKHV | 252 |
| SEQ_ID_NO_286 | PVVLVDHQEA | GVRLVHTLLA | CAEAIQQENL | KLADALVKHI | 244 |
| SEQ_ID_NO_282 | PRMLVDSQET | GVRLVHTLLA | CAEAIQQENL | KLADALVKHI | 235 |
| SEQ_ID_NO_239 | TMVLVDSQEA | GVRLVHTLMA | CAEAIQQDNF | KLAEALKHI | 226 |
| SEQ_ID_NO_277 | PVVLVDSQET | GVRLVHTLMA | CAEAVQQENL | TLADQLVRHI | 225 |

| SEQ ID | | | | | | | End |
|---|---|---|---|---|---|---|---|
| SEQ_ID_NO_188 | PTLAASQGGA | MRKVAAYFGE | ALARRVYRFR | PALDSTLLDA | 306 |
| SEQ_ID_NO_221 | PTLAASQGGA | MRKVAAYFGE | ALARRVYRFR | PALDSTLLDA | 306 |
| SEQ_ID_NO_201 | PMLASSQGGA | MRKVAAYFGE | ALARRVYRFR | PAPDSSLLDA | 305 |
| SEQ_ID_NO_194 | PMLASSQGGA | MRKVAAYFGE | ALARRVYRFR | PPPDSSLLDA | 309 |
| SEQ_ID_NO_215 | PLLASSQGGA | MRKVAAYFGE | ALARRVYRFR | PTPDTSLLDA | 311 |
| SEQ_ID_NO_202 | PMLASSQGGA | MRKVAAYFGE | ALARRVFRFR | PQPDSSLLDA | 296 |
| SEQ_ID_NO_207 | PLLASSQGGA | MRKVAAYFGE | ALARRVYRFR | PTPDSSLLDA | 302 |
| SEQ_ID_NO_283 | PMLASSQGGA | MRKVAAYFGE | ALARRVFRFR | PQPDSSLLDA | 300 |
| SEQ_ID_NO_196 | GLLAASQAGA | MRKVAAYFAE | ALARRIYRIY | PQD-SLES | 294 |
| SEQ_ID_NO_235 | GVLAASQAGA | MRKVAAYFAE | ALARRIYKIY | PQD-HCLDS | 301 |
| SEQ_ID_NO_245 | GILAASQAGA | MRKVAAYFAQ | ALARRIYGIF | PPE-TLES | 289 |
| SEQ_ID_NO_286 | GLLAASQAGA | MRKVAAYFAE | ALARRIYRIY | PQE-CLDS | 281 |
| SEQ_ID_NO_282 | GILAASQTGA | MRKVAAYFAE | ALARRIYGIF | PQE-TLDS | 272 |
| SEQ_ID_NO_239 | GLLAASQASS | MRKVASYFAQ | ALARRLYKIY | PQD-SLDP | 263 |
| SEQ_ID_NO_277 | GLLAVSQSGA | MRKVATYFAE | ALARRLYKIY | PQD-SMES | 262 |

| SEQ ID | | | | | | | End |
|---|---|---|---|---|---|---|---|
| SEQ_ID_NO_188 | AFADLLHAHF | YESCPYLKFA | HFTANQAILE | AFAGCHRVHV | 346 |
| SEQ_ID_NO_221 | AFADLLHAHF | YESCPYLKFA | HFTANQAILE | AFAGCRRVHV | 346 |
| SEQ_ID_NO_201 | AFADLLHAHF | YESCPYLKFA | HFTANQAILE | AFAGCRRVHV | 345 |
| SEQ_ID_NO_194 | AFADLLHAHF | YESCPYLKFA | HFTANQAILE | AFAGCRRVHV | 349 |
| SEQ_ID_NO_215 | AVADFLHAHF | YESCPYLKFA | HFTANQAILE | AFAGCRRVHV | 351 |
| SEQ_ID_NO_202 | AFADLLHAHF | YEACPYLKFA | HFTANQAILE | AFAGANRVHV | 336 |
| SEQ_ID_NO_207 | AVADFLHAHF | YETCPYLKFA | HFTANQAILE | AFAGANRVHV | 342 |
| SEQ_ID_NO_283 | AFADLLHAHF | YESCPYLKFA | HFTANQAILE | AFATASRVHV | 340 |
| SEQ_ID_NO_196 | SYSDILQMHF | YEACPYLKFA | HFTANQAILE | AFATAGRVHV | 334 |
| SEQ_ID_NO_235 | SYSDTLEMHF | YETCPYLKFA | HFTANQAILE | AFATASRVHV | 341 |
| SEQ_ID_NO_245 | SLSDLLEMHF | YESCPYLKFA | HFTANQAILE | AFATAGRVHV | 329 |
| SEQ_ID_NO_286 | SYSDVLHMHF | YESCPYLKFA | HFTANQAILE | AFAGTANRVHV | 321 |
| SEQ_ID_NO_282 | SFSDVLEMHF | YETCPYLKFA | HFTANQAILE | AFATAGRVHV | 312 |
| SEQ_ID_NO_239 | SYSDTLQMHF | YESCPYLKFA | HFTANQAILE | AFGTANRVHV | 303 |
| SEQ_ID_NO_277 | SYTDVLQMHF | YETCPYLKFA | HETANQAILE | AETGCNKVHV | 302 |

| SEQ_ID_NO | Sequence | Pos |
|---|---|---|
| SEQ_ID_NO_188 | VDFGI KQGMQ WPALL QALAL RPGGPPSFRL TGVGPPQPDE | 386 |
| SEQ_ID_NO_221 | VDFGI KQGMQ WPALL QALAL RPGGPPSFRL TGVGPPQPDE | 386 |
| SEQ_ID_NO_201 | VDFGI KQGMQ WPALL QALAL RPGGPPSFRL TGVGPPQPDE | 385 |
| SEQ_ID_NO_194 | VDFGI KQGMQ WPALL QALAL RPGGPPSFRL TGVGPPQPDE | 389 |
| SEQ_ID_NO_215 | VDFGI KQGLQ WPALL QALAL RPGGPPSFRL TGVGPPQPDE | 391 |
| SEQ_ID_NO_202 | VDFGI KQGMQ WPALL QALAL RPGGPPSFRL TGVGPPQHDE | 376 |
| SEQ_ID_NO_207 | VDFGI KQGLQ WPALL QALAL RPGGPPSFRL TGVGPPQPDE | 382 |
| SEQ_ID_NO_283 | DFGI KQGMQ WPALL QALAL RPGGPPSFRL TGVGPPQPDE | 380 |
| SEQ_ID_NO_196 | DFGL KQGMQ WPALM QALAL RPGGPPSFRL TGI GPPQPDE | 374 |
| SEQ_ID_NO_235 | DFGL KQGMQ WPALM QALAL RPGGPPSFRL TGI GPPQPDE | 381 |
| SEQ_ID_NO_245 | DFGL KQGMQ WPALM QALAL RPGGPPSFRL TGI GPPQPDE | 369 |
| SEQ_ID_NO_286 | DFGL KQGMQ WPALM QALAL RPGGPPSFRL TGI GPPQPDN | 361 |
| SEQ_ID_NO_282 | DFGL KQGMQ WPALM QALAL RPGGPPAFRL TGI GPPQPDN | 352 |
| SEQ_ID_NO_239 | DFGL RQGMQ WPALM QALAL RPGGPPTFRL TGI GPPQPDN | 343 |
| SEQ_ID_NO_277 | DFSL KQGMQ WPALM QALAL RPGGPPAFRL TGI GPPQSNN | 342 |

| SEQ_ID_NO | Sequence | Pos |
|---|---|---|
| SEQ_ID_NO_188 | TDALQQVGWK LAQFAHTI RV DFQYRGLVAA TLADLEPFML | 426 |
| SEQ_ID_NO_221 | TDALQQVGWK LAQFAHTI RV DFQYRGLVAA TLADLEPFML | 426 |
| SEQ_ID_NO_201 | TDALQQVGWK LAQFAHTI RV DFQYRGLVAA TLADLEPFML | 425 |
| SEQ_ID_NO_194 | TDALQQVGWK LAQFAHTI RV DFQYRGLVAA TLADLEPFML | 429 |
| SEQ_ID_NO_215 | TDALQQVGWK LAQFAHTI RV DFQYRGLVAA TLADLEPFML | 431 |
| SEQ_ID_NO_202 | TDALQQVGWK LAQFAHTI RV DFQYRGLVAA TLADLEPFML | 416 |
| SEQ_ID_NO_207 | TDALQQVGWK LAQFAHTI RV DFQYRGLVAA TLADLEPFML | 422 |
| SEQ_ID_NO_283 | TDALQQVGWK LAQLAETI GV EFEFRGFVAA SLADLEAEML | 420 |
| SEQ_ID_NO_196 | TDALQQVGWK LAQLAQTI GV EFEFRGFVAS SLADLEPSML | 414 |
| SEQ_ID_NO_235 | TDALQQVGWK LAQLAQTI GV EFEFRGFVCS SLADLDPNML | 421 |
| SEQ_ID_NO_245 | TDALQQVGWK LAQLAETI GV EFEFRGFVAS SLADLTPSML | 409 |
| SEQ_ID_NO_286 | TDALQQVGWK LAQLAQNI GV EFEFRGFVCN SLADLDPKML | 401 |
| SEQ_ID_NO_282 | TDALQQVGWK LAQLADTI GV QFEFRGFVAS SLADLDPEML | 392 |
| SEQ_ID_NO_239 | TDALQQVGWK LAQLAETI GV EFEFRGFVAN SLADLQPEML | 383 |
| SEQ_ID_NO_277 | TDALQQVGWK LAQLAETI GV EFEFRGEVAN SLADLDATLL | 382 |

| SEQ_ID_NO_188 | EGSSSG | -Q- | AEL | SP- | PAAGGGGTD | QVMSEVYLGR | 538 |
|---|---|---|---|---|---|---|---|
| SEQ_ID_NO_221 | GGSSG- | -Q- | AEL | SP- | PAAGGGGTD | QVMSEVYLGR | 538 |
| SEQ_ID_NO_201 | EGAGSG- | -Q- | SAD | AA- | PAF- | QVMSEVYLGR | 534 |
| SEQ_ID_NO_194 | EGAGAGSG | GQ- | STD | AS- | PAT- | QVMSEVYLGR | 540 |
| SEQ_ID_NO_215 | EGGSSG- | -Q- | STDL | AS- | PAT- | QVMSEVYLGR | 540 |
| SEQ_ID_NO_202 | EGAGSG- | -Q- | PSEVSSG | GAA | AAGGTD | QVMSEVYLGR | 531 |
| SEQ_ID_NO_207 | EGGSSG- | -GG | STDL | AS- | AAGGTD | QVMSEVYLGR | 531 |
| SEQ_ID_NO_283 | EGGSSG- | -P- | PSEVSSG | AAA | AAAGTD | QVMSEVYLGR | 536 |
| SEQ_ID_NO_196 | EGSGV- | -P- | --- | AP- | PSSQD | LMMSEIYLGR | 511 |
| SEQ_ID_NO_235 | EGCGV- | -T- | --- | --- | TSQD | LLMSEVYLGR | 517 |
| SEQ_ID_NO_245 | EGSSS- | -T- | GL- | --- | GSPSQD | LVMSEVYLGR | 507 |
| SEQ_ID_NO_286 | EGSGV- | -T- | --- | --- | PSQD | LVMSELYLGK | 495 |
| SEQ_ID_NO_282 | EGSSS- | -V- | GL- | --- | GSPNQD | LVMSELYLGR | 490 |
| SEQ_ID_NO_239 | EGSGLN | --- | SAS | PTG | PSQD | LVMSELYLGR | 479 |
| SEQ_ID_NO_277 | ESSGSSI | -S- | --- | LP- | Q---PPVNNQD | LVMSEVYLGR | 491 |

| SEQ_ID_NO_188 | QI | CNVVACEG | AERTERHETL | GQWRNRLGRA | GFEPVHLGSN | 578 |
|---|---|---|---|---|---|---|
| SEQ_ID_NO_221 | QI | CNVVACEG | AERTERHETL | GQWRNRLGRA | GFEPVHLGSN | 578 |
| SEQ_ID_NO_201 | QI | CNVVACEG | AERTERHETL | GQWRNRLGGA | GFEPVHLGSN | 574 |
| SEQ_ID_NO_194 | QI | CNVVACEG | AERTERHETL | GQWRSRLGGS | GFAPVHLGSN | 580 |
| SEQ_ID_NO_215 | QI | CNVVACEG | AERTERHETL | GQWRGRLVGS | GFEPVHLGSN | 580 |
| SEQ_ID_NO_202 | QI | CNVVACEG | TERTERHETL | GQWRNRLGNA | GFETVHLGSN | 571 |
| SEQ_ID_NO_207 | QI | CNVVACEG | AERTERHETL | GQWRNRLGGS | GFETVHLGSN | 571 |
| SEQ_ID_NO_283 | QI | CNVVACEG | AERVERHETL | GQWRSRMGSA | GFDPVHLGSN | 576 |
| SEQ_ID_NO_196 | QI | CNVVACEG | AERVERHETL | SQWRTRFDSA | GFDPVHLGSN | 551 |
| SEQ_ID_NO_235 | QI | CNVVACEG | AERVERHETL | AQWRTRFDSA | GFDPVHLGSN | 557 |
| SEQ_ID_NO_245 | QI | CNVVAYEG | ADRVERHETL | SQWRGRMGSA | GFDPVHLGSN | 547 |
| SEQ_ID_NO_286 | QI | CNVMACEG | VERVERHETL | SQWRGRMDSA | GFDPVHLGSN | 535 |
| SEQ_ID_NO_282 | QI | CNVVANEG | GDRVERHETL | SQWRGRLDSA | GFDPVHLGSN | 530 |
| SEQ_ID_NO_239 | QI | CNVVACEG | AHRVERHESL | PHWRTRFESA | GFDRVHLGSN | 519 |
| SEQ_ID_NO_277 | QI | CNVVACEG | SDRVERHETL | NQWRVRMNGS | GFDPVHLGSN | 531 |

Figure 3H

| SEQ_ID | | | | | | | SEQ_ID | | |
|---|---|---|---|---|---|---|---|---|---|
| SEQ_ID_NO_188 | AYKQASTLLA | LFAGGDGYRV | EEKEGCLTLG | MHTRPLIATS | 618 | SEQ_ID_NO_188 | AWRVA----A | ---------- | ---------- | 625 |
| SEQ_ID_NO_221 | AYKQASTLLA | LFAGGDGYRV | EEKEGCLTLG | MHTRPLIATS | 618 | SEQ_ID_NO_221 | AWRVA----A | ---------- | ---------- | 625 |
| SEQ_ID_NO_201 | AYKQASTLLA | LFAGGDGYRV | EEKDGCLTLG | MHTRPLIATS | 614 | SEQ_ID_NO_201 | AWRVA----A | ---------- | ---------- | 621 |
| SEQ_ID_NO_194 | AYKQASTLLA | LFAGGDGYRV | EEKDGCLTLG | MHTRPLIATS | 620 | SEQ_ID_NO_194 | AWRVAAAA-A | ---------- | ---------- | 630 |
| SEQ_ID_NO_215 | AYKQASTLLA | LFNGGDGYKV | EEKDGCLTLG | MHTRPLIATS | 620 | SEQ_ID_NO_215 | AWRLA----A | ---------- | ---------- | 627 |
| SEQ_ID_NO_202 | AYKQASTLLA | LFNGGDGYKV | EEKEGCLTLG | MHTRPLIATS | 611 | SEQ_ID_NO_202 | AWRLA----A | ---------- | ---------- | 618 |
| SEQ_ID_NO_207 | AYKQASTLLA | LFAGGDGYKV | EEKEGCLTLG | MHTRPLIATS | 611 | SEQ_ID_NO_207 | AWRLA----G | ---------- | ---------- | 618 |
| SEQ_ID_NO_283 | AFKQASTLLA | LFAGGDGYRV | EENNGCLTLG | MHTRPLIATS | 616 | SEQ_ID_NO_283 | AWQLA----N | ---PTSTSAS | TSAHSQ---- | 623 |
| SEQ_ID_NO_196 | AFKQASMLLA | LFAGGDGYRV | EENNGCLMLG | MHTRPLIATS | 591 | SEQ_ID_NO_196 | AWQLA----SN | FN-PTSTSAS | ---------- | 613 |
| SEQ_ID_NO_235 | AFKQASMLLA | LFAGGDGYRV | EENNGCLMLG | MHTRPLIATS | 597 | SEQ_ID_NO_235 | AWQLA----AG | DSRLRVNSAE | FELPSQ---- | 620 |
| SEQ_ID_NO_245 | AFKQASMLLA | LFAGGDGYRV | EENNGCLMLG | MHTRPLIATS | 587 | SEQ_ID_NO_245 | AWKLP----SP | ---------- | ES----E--- | 596 |
| SEQ_ID_NO_286 | AFKQASMLLA | LFAGGDGYRV | EENNGCLMLG | MHTRPLIATS | 575 | SEQ_ID_NO_286 | AWKLP----SA | ---------- | TE----P--- | 584 |
| SEQ_ID_NO_282 | AFKQASMLLA | LFAGGDGYRV | EENNGCLMLG | MHTRPLIATS | 570 | SEQ_ID_NO_282 | AWQLA----D- | ND-------- | LHCKL-K--- | 584 |
| SEQ_ID_NO_239 | AFKQASMLLA | LFAGGDGYRV | EENNGSLMLG | MHTRPLIATS | 559 | SEQ_ID_NO_239 | AWQLS----- | ---------- | SK----P--- | 567 |
| SEQ_ID_NO_277 | AEKQASMLLA | LFAGGDGYRV | EENDGCLMLG | MHTRPLIATS | 571 | SEQ_ID_NO_277 | AWKLL----PD | SG-------- | AGEVELTG-- | 588 |

Figure 31

| SEQ_ID_NO_1 | MPTP | A- | --- | --- | --- | HLS | --- | KDPHYFD | FRAARRVPET | 25 |
|---|---|---|---|---|---|---|---|---|---|---|
| SEQ_ID_NO_2 | MPTP | S- | --- | --- | --- | HLS | --- | KDPHYFD | FRAARRVPET | 25 |
| SEQ_ID_NO_3 | MPTP | S- | --- | --- | --- | HLS | --- | NDPRYFD | FRAARRVPET | 25 |
| SEQ_ID_NO_4 | MPTP | A- | --- | --- | --- | HLS | --- | KDPHYFD | FRAARRVPET | 25 |
| SEQ_ID_NO_6 | MPTP | S- | --- | --- | --- | --- | --- | KDPHYFD | FRAARRVPET | 24 |
| SEQ_ID_NO_8 | MPTP | S- | --- | --- | --- | HL- | HLANPRYFD | | FRAARRVPES | 24 |
| SEQ_ID_NO_9 | MPTP | S- | --- | --- | --- | HLK | KNPLYFD | | FRAARRVPET | 24 |
| SEQ_ID_NO_10 | MQSS | S- | --- | --- | --- | SSAST | -P | NPLQFD | LGSAAGVPET | 30 |
| SEQ_ID_NO_11 | MPSL | -- | --- | --- | --- | MEQPI | HFP | ASGLVFD | LGSAHEVPDS | 33 |
| SEQ_ID_NO_12 | MPSR | -- | --- | --- | --- | SDAFKAHP | AA- | QPIHHPKHFD | LNSVQELPET | 32 |
| SEQ_ID_NO_13 | MPAR | L- | LSDAF | KSHPL | --- | LH- | NHRHLD | | FSSLQELPDS | 32 |
| SEQ_ID_NO_14 | MPAP | R- | --- | --- | --- | MDPYKDKS | NL- | QLKHPD | FQSVEELPDA | 34 |
| SEQ_ID_NO_15 | MHTN | -- | --- | --- | --- | SM- | SHY | HRRHLD | LNSMKVLPES | 24 |
| SEQ_ID_NO_16 | MPSR | -- | --- | --- | --- | SDSFRAL | -- | LNQKHLD | LNSIKELPES | 28 |
| SEQ_ID_NO_17 | MPSR | -- | --- | --- | --- | SEAYRAHP | VH- | HSQKHLD | FNSLQELPES | 31 |
| SEQ_ID_NO_18 | MPTR | P- | --- | --- | --- | SDSFRPH- | --- | VNHKHPD | LNSIKELPES | 29 |
| SEQ_ID_NO_19 | MPSL | -- | --- | --- | --- | SRVVKL- | -E | HSQKHFD | LEISLNELPDS | 31 |
| SEQ_ID_NO_20 | MPSL | -- | --- | --- | --- | SEAYRAHP | QHP | IKKSFLD | FNSLQELPES | 31 |
| SEQ_ID_NO_21 | MPVR | D- | --- | --- | --- | SEAFPSHP | VH- | KHYPAD | ENSLHELPDS | 30 |

| SEQ ID | col1 | col2 | col3 | col4 | Block 1 | Block 2 | Block 3 | # |
|---|---|---|---|---|---|---|---|---|
| SEQ_ID_NO_1 | - | - | - | P-F | - | AAEAVGLAAQ | DWGAFLLVGH | GVPLDLLVRV | 88 |
| SEQ_ID_NO_2 | - | - | - | P-C | - | AAEAVALAAQ | DWGAFLLQGH | GVPLELLARV | 88 |
| SEQ_ID_NO_3 | - | - | - | P-C | - | AAEAVALAAQ | DWGAFLLEGH | GVPLELLERV | 88 |
| SEQ_ID_NO_4 | - | - | - | P-G | - | AAEAVARAAQ | QWGAFLLEGH | GVPLELLQRV | 87 |
| SEQ_ID_NO_6 | - | - | - | PRAA | - | AVAQVARAAE | QWGAFLLTGH | GVPAELLARV | 91 |
| SEQ_ID_NO_8 | - | - | - | SGAA | - | AAAGVARAAE | LMGAFLLTGH | GVPAELLARV | 89 |
| SEQ_ID_NO_9 | - | - | - | G-  | - | AARVARAAE  | QWGAFLLVGH | GVPAALSRV  | 86 |
| SEQ_ID_NO_10 | - | - | - | ACPD | - | ATRALARAAD | EMGVFLLVGH | GVPREVAARA | 91 |
| SEQ_ID_NO_11 | - | - | - | P-D | - | VISLIGHACE | SWGVFQVISH | GVDLNLLHNL | 90 |
| SEQ_ID_NO_12 | - | - | - | P-N | - | ASELVGHACK | SWGVFQVTNH | GIPGSLLDDI | 91 |
| SEQ_ID_NO_13 | - | - | - | P-N | - | ALKLTGHACR | TWGVFQVTNH | GIPSKLLDDI | 95 |
| SEQ_ID_NO_14 | - | - | - | P-N | - | ARELGSACK  | KWGAFQIINH | GVPQRELEEV | 92 |
| SEQ_ID_NO_15 | - | YI | NNN | P-N | - | AMNLVGHACK | TWGVFQIINH | GVPINLLEKM | 83 |
| SEQ_ID_NO_16 | - | -  | NNN | -N- | - | VLEHIGQACK | KWGAFQIINH | NISERLLQDI | 93 |
| SEQ_ID_NO_17 | - | -  | -   | P-N | - | ASKLIGHACK | SWGVFQIINH | GIPISLLDEI | 97 |
| SEQ_ID_NO_18 | - | -  | -   | P-N | - | ILDHIGHACK | TWGVFQIINH | SISERLLQDI | 94 |
| SEQ_ID_NO_19 | - | -  | -   | P-Q | - | AQLVGLACR  | KWGAFQIINH | GIQKSLLDDI | 93 |
| SEQ_ID_NO_20 | - | -  | -   | P-N | - | ASKLIGLACR | SWGVYQVMNH | GIPLSLLEDI | 95 |
| SEQ_ID_NO_21 | - | -  | -   | P-N | - | VIKLIGHACK | TWGVFQVTNH | GVPQKLVHDI | 92 |

Figure 4C

| SEQ_ID | Seq | Len |
|---|---|---|
| SEQ_ID_NO_1 | EAAIAGMFAL PASEKMRAVR RPGD- -SCGY GSPPI SSFFS | 126 |
| SEQ_ID_NO_2 | EAAIAGMFAL PASEKMRAVR RPGD- -SCGY GSPPI SSFFS | 126 |
| SEQ_ID_NO_3 | EAAIAGMFAL PASEKMRAVR RPGD- -SCGY GSPPI SSFFS | 126 |
| SEQ_ID_NO_4 | EARIAGMFAL PAQEKMRAVR RPGD- -SCGY GSPPI SSFFA | 125 |
| SEQ_ID_NO_6 | EDRIATMFAL PADDKMRAVR GPGD- -ACGY GSPPI SSFFS | 129 |
| SEQ_ID_NO_8 | EDRIARMFAL PAADKMRAVR GPGD- -ACGY GSPPI SSFFS | 127 |
| SEQ_ID_NO_9 | EERVARVFSL PASEKMRAVR GPGE- -PCGY GSPPI SSFFS | 124 |
| SEQ_ID_NO_10 | EEQVARLFVL PAPDKARAGR RPGE- -ATGY GRPPLALRFN | 131 |
| SEQ_ID_NO_11 | ESQARRLFSL PAPDKARAGR SPNS- -PT-- GLAPISSLFS | 128 |
| SEQ_ID_NO_12 | ESAGRSLFSL PAQQKLKAGR SPDG- -ISGY GLARISSFFN | 129 |
| SEQ_ID_NO_13 | ESAGRSLFSL PVQQKLKAAR SPDG- -VAGY GLARISSFFP | 133 |
| SEQ_ID_NO_14 | ESAGRRLFSL PLHQKLKAAR APDG- -LSGY GFARISSFFP | 130 |
| SEQ_ID_NO_15 | EAAGRKLFAL PLQQKLKAAR SPEG- -VTGY GPARISSFFP | 121 |
| SEQ_ID_NO_16 | ELAGKSLFSL PMQQKLKAAR SPDG- -VSGY GVARISSFFS | 131 |
| SEQ_ID_NO_17 | QWLGQTLFTL PSHQKLKAAR SPDG- -VTGY GVARISSFFP | 135 |
| SEQ_ID_NO_18 | DVAGKTLFSL PMQQKLKAAR SPDG- -VTGY GLARISLFSP | 132 |
| SEQ_ID_NO_19 | EAAGKSLFAL PVNQKLKAAR SSCG- -VSGY GAAQIASSFFP | 131 |
| SEQ_ID_NO_20 | QWLGQTLFSL PSHQKHKATR SPDG- -VSGY GPAGISSFFP | 133 |
| SEQ_ID_NO_21 | ESTCRSLFSL PVQQKLKAAR PADG- -LSGY GIHRISSFFQ | 130 |

| SEQ ID | Block 1 | Block 2 | Block 3 | Block 4 | Pos |
|---|---|---|---|---|---|
| SEQ_ID_NO_1 | KCMWSEGYTF | SPANLRSDLR | KLWPKAGHDY | RHFCAVMEEF | 166 |
| SEQ_ID_NO_2 | KCMWSEGYTF | SPANLRSDLR | KLWPKAGHDY | RHFCAVMEEF | 166 |
| SEQ_ID_NO_3 | KCMWSEGYTF | SPANLRSDLR | KLWPKAGHDY | RHFCAVMEEF | 166 |
| SEQ_ID_NO_4 | KSMWSEGYTF | SPANLRSDLR | KLWPKQGHDY | RLFCDVMEEF | 165 |
| SEQ_ID_NO_6 | KCMWSEGYTF | SPANLRADLR | KLWPKAGDDY | TSFCDVMEEF | 169 |
| SEQ_ID_NO_8 | KCMWSEGYTF | SPANLRADLR | KLWPKAGDDY | ASFCDVMEEF | 167 |
| SEQ_ID_NO_9 | KLMWSEGYTF | SPANLRADLR | RLWPKSGDDY | LLFCDVMEEY | 164 |
| SEQ_ID_NO_10 | KLMWSEGYTF | SPSSLRSELR | RVWPDGGDDY | LRFCEVLEEY | 171 |
| SEQ_ID_NO_11 | KLMWYEGFTI | RAIATVREEFR | SLWPD---DY | FNFCEVI-EEF | 164 |
| SEQ_ID_NO_12 | KLMWEGFTI | SGSPLFDHAR | QLWPQ---DY | TKFCDVIEEY | 165 |
| SEQ_ID_NO_13 | KLLVSEGFTI | FGSPLFEHAR | QLWPQ---DY | NKFCNI-EEY | 169 |
| SEQ_ID_NO_14 | KLMWSEGFTI | VGSPLFDHFR | QLWPQ---DY | QNFCEI-EEY | 166 |
| SEQ_ID_NO_15 | KLMWSEGFTI | EGSPE-DHAR | KLWPN---SY | TRFCDVI-EEY | 157 |
| SEQ_ID_NO_16 | KLMWSEGFTI | MGSPY-EHAR | QIWPH----DY | QKFCDVI-EEY | 167 |
| SEQ_ID_NO_17 | KLMWSEGFTI | VGSPLFEHAR | QLWPQ---DY | AKHCDITVLQY | 171 |
| SEQ_ID_NO_18 | KLMWSEGFTI | IGSPLFEHAR | QLWPK---DY | KKFCEVI-EEY | 168 |
| SEQ_ID_NO_19 | KLMWSEGFTI | LGSPLFDHFR | QLWPN---NY | NKFCDI-EKY | 167 |
| SEQ_ID_NO_20 | KLMWYEGFTI | VGSPLFDHAR | ELWPQ---DY | TRFCDI-VMQY | 169 |
| SEQ_ID_NO_21 | KLMWSEGFTL | VGSPLFEHFR | QLWPQ---DY | NKECCMVEEY | 166 |

| | | | | | | |
|---|---|---|---|---|---|---|
| SEQ_ID_NO_1 | HREMRALADK | LELFLVALG | LTGEQVA | AV | E-SEQKI AET | 204 |
| SEQ_ID_NO_2 | HREMRVLADK | LELFLVALG | LTGEQVA | AV | E-SEHKI AET | 204 |
| SEQ_ID_NO_3 | HREMRALADK | LELFLVALG | LTGEQVA | AV | E-SEQQI AET | 204 |
| SEQ_ID_NO_4 | HGEMRALSDR | MELFLAALG | LTGEQAI | AV | E-AEHRI AET | 203 |
| SEQ_ID_NO_6 | HKHMRALADK | LELFLVALG | LTDEQVG | GV | E-AERRI AET | 207 |
| SEQ_ID_NO_8 | HKEMRVLAGK | LELFLRALG | LDEEVAL | AV | E-EERRI GET | 205 |
| SEQ_ID_NO_9 | HKEMRRLADE | LRLFLRLG | LTGEVAL | GV | E-AERRI GER | 202 |
| SEQ_ID_NO_10 | DREMRALGGR | LDLFFMALG | LTDVQFA | TG | E-TERRI RET | 209 |
| SEQ_ID_NO_11 | NKEMKRVAER | LLDLMQLSLG | LTEEITV | KI | G-PMNELFQD | 201 |
| SEQ_ID_NO_12 | EKEMNQLAER | LMWLMLGSLG | ITSMEDVN- | WA | G-SKGDF--D | 199 |
| SEQ_ID_NO_13 | EKVMKRLAGR | LMWLMLGSLG | ISMEDVKL | WA | G-PKGDFRLD | 206 |
| SEQ_ID_NO_14 | DRDMKRLAGR | LMWLVLGSLG | VTMEDVKL | WA | G-PTGDFNDI | 204 |
| SEQ_ID_NO_15 | KEEMNKLAQT | LMSLMLGSLG | ITKEEVKL | WA | G-SQGL---- | 190 |
| SEQ_ID_NO_16 | EREMEKLAGR | LMWLMLGSLG | ITMEDIEL | WA | VCPKGES-KG | 205 |
| SEQ_ID_NO_17 | DEAMKKKLAGK | LMWLILGSLG | ITKDEVKL | WA | G-SKAQFDEK | 209 |
| SEQ_ID_NO_18 | EKEMEKLAGR | LMQLVVGSLG | ISNQDIMNWA | WA | G-PKGEIT-KE | 206 |
| SEQ_ID_NO_19 | QKEMNQLAKK | LMQLMLDSLG | ITKEDIKL | WA | D---LILEG | 202 |
| SEQ_ID_NO_20 | DETMKKLAGT | LMWLIFGSLG | LSKEDVS- | WA | G-SKAQFLEK | 206 |
| SEQ_ID_NO_21 | EITEMKKLAGR | | | | G-PKGDFE-D | 203 |

| | | | | | |
|---|---|---|---|---|---|
| SEQ_ID_NO_1 | GLQLFRHG- | ---- | -PDRWTV | PA- | VPGAMVV | NVGDLFQILT | 278 |
| SEQ_ID_NO_2 | GLQLFRHG- | ---- | -PDRWTV | PA- | VPGAMVV | NVGDLFQILT | 278 |
| SEQ_ID_NO_3 | GLQLFRHG- | ---- | -PDRWTV | PA- | VPGAMVV | NVGGLFQILT | 278 |
| SEQ_ID_NO_4 | GLQLFRHG- | ---- | -PDRWTV | PAD | VPGQAFVV | NVGDLFQILT | 278 |
| SEQ_ID_NO_6 | GLQLFRHG- | ---- | -PDRWTV | PA- | VPGAFVV | NVGDLFQILT | 281 |
| SEQ_ID_NO_8 | GLQLFRHA- | ---- | -PDRWAV | PA- | VPGAFVV | NVGDLFHILT | 279 |
| SEQ_ID_NO_9 | GLQLFRHA- | ---- | -PDRWAV | PA- | VAGAFVV | NVGDLFQVLT | 276 |
| SEQ_ID_NO_10 | GLQLFRRG- | ---- | -PDRWTV | PA- | PPGALIV | MLGDLFQVLT | 283 |
| SEQ_ID_NO_11 | GLQVLRPNKE | SSPT | QWTV | PPI | IPGALVV | NVGDLCHILS | 279 |
| SEQ_ID_NO_12 | GLQVQREG- | ---- | ALGWTV | PPI | LPGALVI | NVGDLLHILS | 272 |
| SEQ_ID_NO_13 | GLQVLREG- | ---- | TLGWTV | PPI | LPGALVV | NVGDLLHILS | 279 |
| SEQ_ID_NO_14 | GLQVHRDG- | ---- | -LGWWM | PPI | VPGALVI | NIGDLLHILS | 277 |
| SEQ_ID_NO_15 | GLQAHRDG- | ---- | ALGWTV | PPI | LPGALVI | NVGDLFHILS | 263 |
| SEQ_ID_NO_16 | GLQVFKEG- | ---- | SLGWTV | PPI | LHGGLVV | NVGDLFHILS | 278 |
| SEQ_ID_NO_17 | GLQVQREG- | ---- | SLGWTV | PPI | PGALVV | NVGDLFHILS | 282 |
| SEQ_ID_NO_18 | GLQVYQEG- | ---- | N-GWTV | PPI | SGGLVI | NVGDLFHILS | 279 |
| SEQ_ID_NO_19 | GLQVFRER- | ---- | SLGMTV | PPI | LQGLVV | NIGDLLHILS | 275 |
| SEQ_ID_NO_20 | GLQVNREG- | ---- | SLGMTV | PPI | PGALVV | NVGDLFHILS | 279 |
| SEQ_ID_NO_21 | GLQVLREG- | ---- | ALGWLTV | PPI | VAGALVI | NIGDLLHILS | 276 |

Figure 4H

| | | | | | |
|---|---|---|---|---|---|
| SEQ_ID_NO_1 | NGRFHSVYHR | AVVNRESDRI | SLGYFLGPPA | HVKVAPLREA | 318 |
| SEQ_ID_NO_2 | NGRFHSVYHR | AVVNRDSDRI | SLGYFLGPPA | HVKVAPLREA | 318 |
| SEQ_ID_NO_3 | NGRFHSVYHR | AVVNRDSDRI | SLGYFLGPPA | HVKVAPLREA | 318 |
| SEQ_ID_NO_4 | NGRFHSVYHR | AVVNRDLDRI | SLGYFHGPPA | DTKVAPLREA | 318 |
| SEQ_ID_NO_6 | NGRFHSVYHR | AVVNRDLDRI | SLGYFLGPPA | HAKVAPLREA | 321 |
| SEQ_ID_NO_8 | NGRFHSVYHR | AVVNRDRDRV | SLGYFLGPPP | HAKVAPLREA | 319 |
| SEQ_ID_NO_9 | NGRFHSVYHR | AVVSRERERL | SVPYFLCPPE | DAEVAPLPEA | 316 |
| SEQ_ID_NO_10 | NGRFRSPIHR | AVVNRTEHRY | SAAYLCGPPA | DMTVAPLASA | 323 |
| SEQ_ID_NO_11 | NGIXFHSVVHR | ALVNRTKHRL | SVAYLYGPPA | HVKVSPIVKP | 319 |
| SEQ_ID_NO_12 | NGLFPSVVHR | AVVNRSRHRL | SIAYLYGPPA | GVPISPVPKL | 312 |
| SEQ_ID_NO_13 | NGLYPSVLHR | AVVNRTHHRL | SVAYLFGPPQ | SVQISPLSKL | 319 |
| SEQ_ID_NO_14 | NGLYPSVLHR | AMVNRTKHRL | SVAYLYGPPS | SVRISPLERL | 317 |
| SEQ_ID_NO_15 | NGLYPSVLHR | AVVNRTRHRL | SVAYLYGPPS | NVQISPLSKL | 303 |
| SEQ_ID_NO_16 | NGLYPSVLHR | AVVNRTRHRL | SVAYLYGPPS | RVKVSPLAKL | 318 |
| SEQ_ID_NO_17 | NGLYTSVLHR | AVVNRTRQRF | SVAYLYGPPT | NVEICPHEKL | 322 |
| SEQ_ID_NO_18 | NGSYPSVLHR | AVVNRIRHRL | SVAYLYGPPS | GVRVSPLSKL | 319 |
| SEQ_ID_NO_19 | NGRYPSVYHR | AMVNRVQHRL | SVAYLYGPAS | GVRVQPLPKL | 315 |
| SEQ_ID_NO_20 | NGLYPSVLHR | VLVNRTRQRF | SVAYLYGPPS | NVEICPHAKL | 319 |
| SEQ_ID_NO_21 | NGEYQNVFHR | ALVNRSQQRL | SVAYLYGPPI | NVQISPHSKL | 316 |

| SEQ_ID | Sequence | Position |
|---|---|---|
| SEQ_ID_NO_1 | D- - - -D- - - - - - - - - - -T-DDL | 366 |
| SEQ_ID_NO_2 | D- - - -D- - - - - - - - - - -L-PDV | 366 |
| SEQ_ID_NO_3 | D- - -F-D- - - - - - - - - - -A-DDL | 365 |
| SEQ_ID_NO_4 | S- -EA-V- - - - - - - - - - - - -DDL | 369 |
| SEQ_ID_NO_6 | A- -AA-A-DAGAGAAA- - - - -T-QQL | 386 |
| SEQ_ID_NO_8 | A- -E-S-A- - - - - - - - - - -L-PLV | 371 |
| SEQ_ID_NO_9 | A- -A- -D-H- - - - - - - - - -Q-DDV | 365 |
| SEQ_ID_NO_10 | D- - - - - -DD- - - - - - - - -H-GERA | 371 |
| SEQ_ID_NO_11 | G- -F- -EE- - - - - - - - - -NSTGL-L | 362 |
| SEQ_ID_NO_12 | A- -L-V-DHN- - - - - - - - - -H-NGV | 362 |
| SEQ_ID_NO_13 | G- -F- -DVN-D- - - - - - - - -H-NSV | 369 |
| SEQ_ID_NO_14 | G- -F- -DVS-V- - - - - - - - -S-SLV | 364 |
| SEQ_ID_NO_15 | G- -F-A-DRT-D- - - - - - - - -H-NGV | 353 |
| SEQ_ID_NO_16 | G- -L-T-DAN-D- - - - - - - - -H-NGV | 368 |
| SEQ_ID_NO_17 | G- -F-F-DAK-D- - - - - - - - -SNKSSV | 374 |
| SEQ_ID_NO_18 | G- -L-A-DVN-D- - - - - - - - -H-NGV | 369 |
| SEQ_ID_NO_19 | PSLTGL-L-DAK-S-NDEPKSI- - - -DKITLA | 379 |
| SEQ_ID_NO_20 | G- -E- -NVD-D-EPVVH- - - - -SNKNSV | 371 |
| SEQ_ID_NO_21 | G- - - - -DVN- - - - - - - - - - - -N- | 355 |

| | | |
|---|---|---|
| SEQ_ID_NO_1 | L S | 369 |
| SEQ_ID_NO_2 | L S S | 369 |
| SEQ_ID_NO_3 | - S S | 368 |
| SEQ_ID_NO_4 | - S S | 372 |
| SEQ_ID_NO_6 | V S S | 389 |
| SEQ_ID_NO_8 | L S S | 374 |
| SEQ_ID_NO_9 | AAAA D V H A | 373 |
| SEQ_ID_NO_10 | A T T | 374 |
| SEQ_ID_NO_11 | S C V | 365 |
| SEQ_ID_NO_12 | K V G | 365 |
| SEQ_ID_NO_13 | K V G | 372 |
| SEQ_ID_NO_14 | E V G S | 368 |
| SEQ_ID_NO_15 | Q V G | 356 |
| SEQ_ID_NO_16 | Q V G | 371 |
| SEQ_ID_NO_17 | Q V G | 377 |
| SEQ_ID_NO_18 | Q V G | 372 |
| SEQ_ID_NO_19 | V E G | 382 |
| SEQ_ID_NO_20 | Q V G | 374 |
| SEQ_ID_NO_21 | D Q M | 358 |

| SEQ_ID_NO_287 | DMSDPESKHA | LVKACEDFGF | FKVINHGVSA | ELVSVLEHET | 61 |
|---|---|---|---|---|---|
| SEQ_ID_NO_288 | DLSEPDSKHL | VVKSCEEFGF | FKVINHGIPL | ELISRLETEV | 70 |
| SEQ_ID_NO_290 | DLSKPDSKHL | LVKACEEFGF | FKVVNHGVPL | EFISKLESEA | 70 |
| SEQ_ID_NO_291 | DLSKPDSRQQ | IKACEEFGF | FKVINHGVPM | DFISRLESEA | 71 |
| SEQ_ID_NO_292 | DLSAPDAKQL | VKACEELGF | FKVVKHGVPM | ELISSLESES | 58 |
| SEQ_ID_NO_293 | DLKDPEAKTR | VEACQEFGF | FKLVNHGVPF | EFMTRLEYLA | 71 |
| SEQ_ID_NO_294 | DLSAPDAKHL | VKACEELGF | FKVINHGVPM | EFISTLESEA | 63 |
| SEQ_ID_NO_295 | DLTKPDSKQL | VNACEEFGF | FKIINHGVPL | DFIRLESEA | 71 |
| SEQ_ID_NO_296 | DLSKPESKQH | LVKACCQDFGF | FKVVNHGVPM | KFIKKLESEA | 72 |
| SEQ_ID_NO_297 | DLSAPDAKHL | VKACEEFGF | FKVINHGVPI | DFISTLESEA | 68 |
| SEQ_ID_NO_298 | DLSKPNSKNL | VNACEEFGF | FKVINHSVPT | EFITKLESEA | 70 |
| SEQ_ID_NO_299 | DLSKPESKQH | LVKACQEFGF | FKLVNHGVPL | DFMTRLESLA | 71 |
| SEQ_ID_NO_300 | DLTDPEAKNL | VKACCQDFGF | FKVVNHGVPI | FINKLESEA | 69 |
| SEQ_ID_NO_301 | DLSKPDSKQL | VEACEEFGF | FKLVNHGVPL | EFISKLESEA | 72 |
| SEQ_ID_NO_303 | DLTDPDAKTH | VNACRDFGF | FKVTNHGIPM | QFMANLENET | 70 |
| SEQ_ID_NO_305 | DLTDPPHAKTL | IKACEEFGF | FKLVNHGVPA | EVMTKLEALA | 70 |
| SEQ_ID_NO_306 | NLAQPGSETL | LVRACEERFGF | FKLVNHGVAL | ELIARLEEEA | 71 |
| SEQ_ID_NO_308 | DLSRPGAPRA | ADACERFGF | FKVVNHGVAT | DTMDRLESEA | 71 |
| SEQ_ID_NO_309 | DLGSPGAARA | ADACERYGF | FKVINHGVPA | DAMDRLEAEA | 71 |
| SEQ_ID_NO_310 | DLSGPDAAGD | VVRACEQFGF | FSVVNHGVPT | DTMDKAESEA | 71 |
| SEQ_ID_NO_311 | DLSSPGAALA | VVDACERFGF | FKVVNHGVPT | GVVDRLEAEA | 74 |
| SEQ_ID_NO_313 | DLSNPDAKTQ | VNACQEFGF | FKVINHGVPM | EIVTKLEAQA | 69 |
| SEQ_ID_NO_314 | | | | | |

| SEQ ID | | | | | End |
|---|---|---|---|---|---|
| SEQ_ID_NO_287 | VDFFSLPKSE | KTQVA--GY | PFGYGNSKIG | RNGDVGWEY | 98 |
| SEQ_ID_NO_288 | LEFFSLSLSE | KQKAGPL-PD | PFGYGNRSIG | PNGDVGWEY | 108 |
| SEQ_ID_NO_290 | VKFFSLPLSE | KEKASPL-PN | PFGYGKKSIG | QNGDVGWEY | 108 |
| SEQ_ID_NO_291 | TKFFSLPLSE | KEKITGQ-PK | PPYGYGNKRIG | PNGDVGWEY | 109 |
| SEQ_ID_NO_292 | TKFFSLPLSE | KQRAGPL-PS | PFGYGNKQIG | PNGDVGWEY | 96 |
| SEQ_ID_NO_293 | MNFFNLPQSE | KDKAGPL-PS | PLGYGNKQHG | RNGDVGWEY | 109 |
| SEQ_ID_NO_294 | TKFFSLPLSE | KQRAGPL-PN | PFGYGNKRIG | PNGDVGWEY | 101 |
| SEQ_ID_NO_295 | IKFFSSPLSE | KEKAGPL-PD | PFGYGNKVG | KNGDVGWEY | 109 |
| SEQ_ID_NO_296 | LRFFSSPLSE | KLKAGPL-AD | PFGYGNKKIG | RNGDVGWEY | 110 |
| SEQ_ID_NO_297 | IKFFSSPLSE | KQKAGPL-PD | PFGYGNKQIG | ACGDI GWEY | 106 |
| SEQ_ID_NO_298 | NFFNLPQSE | KDKAGPL-PD | PFGYGNKKIG | PNGDI GW | 108 |
| SEQ_ID_NO_299 | VNFFNSPLAT | KEKFGPL-AD | PFGYGNKKIG | QSGDI GWEY | 109 |
| SEQ_ID_NO_300 | IKFFSSPLSE | KLKAGPL-PD | PFGYGNKQIG | PNGDVGWEY | 107 |
| SEQ_ID_NO_301 | LGFFKKPQSE | KDRAGPL-PN | PFGSKRIG | HTGDVGWEY | 110 |
| SEQ_ID_NO_303 | TNFFNLPQPE | KERAGT-GN | PFGYGSKRIG | LNGDMGWLEY | 108 |
| SEQ_ID_NO_305 | VKFFSLAQVE | KDRSGPL-AY | PFGYGSKRIG | LNGDMGWLEY | 108 |
| SEQ_ID_NO_306 | VRFFSLPQAD | KDRSGPL-AY | PFGYGSKRIG | ENGDMGWLEY | 108 |
| SEQ_ID_NO_308 | VRFFSQTQPD | KDASAPAGAD | PFGYGNKRIG | RNGDMGWLEY | 109 |
| SEQ_ID_NO_309 | VRFFGSSDAV | KDACGPL-AN | PLGYGNKRIG | RNGDMGWEY | 111 |
| SEQ_ID_NO_310 | VRFFASPQAD | KNKA----A | PFGYGNKNIG | RKGDTGWEY | 112 |
| SEQ_ID_NO_311 | LSFFKQPQNH | | | | 104 |

Figure 5D

| SEQ_ID_NO | Sequence | Length |
|---|---|---|
| SEQ_ID_NO_287 | MTFDVLEKIT DGLGI KPRNT LSKLVSDQNT DSILRL NHYP | 176 |
| SEQ_ID_NO_288 | MACELLELMA DGLRI KPRNV FSKLL MDEQS DSVFRL NHYP | 186 |
| SEQ_ID_NO_290 | MACEILEMMA DGLKI QNRNV FSKLL MDEQS DSVFRL NHYP | 186 |
| SEQ_ID_NO_291 | MACEILEMIA DGLKI QPRNV LSKLL MDEQS DSVFRL NHYP | 182 |
| SEQ_ID_NO_292 | MAGEILELMA EGLKI QQRNA FSKLV MMDEQS DSVFRV NHYP | 174 |
| SEQ_ID_NO_293 | MTYEVLELMA DGLGI EPRNV LSKLV SDEKS DSCFRL NHYP | 187 |
| SEQ_ID_NO_294 | MACEIVELMA EGLKI QQRNA LSKLL MGEES DSVFRV NHYP | 175 |
| SEQ_ID_NO_295 | MTCEILELMS DEMKL QPRNV FSKLL MDEQS DSCFRL NHYL | 187 |
| SEQ_ID_NO_296 | MACEILELLA DGLKI QPRNV FSKLL MDEQS DSVFRL NHYP | 188 |
| SEQ_ID_NO_297 | MACEILELLA EGLNI HPRNV FSKLL MDEKS DSVFRV NHYP | 185 |
| SEQ_ID_NO_298 | MACEILEMLA DGLGI HPRNV LSRML KDDKS DSVFRL NYYP | 186 |
| SEQ_ID_NO_299 | MAYEVLELMA DELKL QPRNV FSKLL KDEQS DSVFRL NHYP | 187 |
| SEQ_ID_NO_300 | MACEILELLA EGLKI HPTNV FSKLL KDEKS DSCFRL NHYP | 175 |
| SEQ_ID_NO_301 | MSCEILEKLA EGLGI TQRNV SRLL MDEES DSILRL NHYP | 188 |
| SEQ_ID_NO_303 | MCYEVLELMA DGLEI ESRNV FSRLL RDDKS DQVFRV NHYP | 186 |
| SEQ_ID_NO_305 | MAFEVLELMA EGLRV QPRNI LSKLV MDEES DQVFRV NHYP | 185 |
| SEQ_ID_NO_306 | LVCEVLELMA EGLGI APVDA LSAMV TAGGS DQVFRL NHYP | 187 |
| SEQ_ID_NO_308 | VAVRVMEAMA EGLGI AQADA LSAMV AAEGS DQVFRV NHYP | 184 |
| SEQ_ID_NO_309 | VAVRVMEAMS EGLGI AQADA LSALV TAEGS DQVFRV NHYP | 184 |
| SEQ_ID_NO_310 | LAVRVMEAMS DGLGV SPRGA LADMV TGDAS DQVFRL NHYP | 184 |
| SEQ_ID_NO_311 | LARTVLEMVA EGLGV APRDA LSGMV TDAAS DQVFRI NHYP | 187 |
| SEQ_ID_NO_313 | LATSVLEAVA EELNI QPKNV LSRLL SDKKS DSFERI NHYP | 187 |
| SEQ_ID_NO_314 | LACEILKLMA | 179 |

| SEQ_ID_NO | Segment 1 | Segment 2 | Insert | Segment 3 | Segment 4 | Segment 5 | Pos |
|---|---|---|---|---|---|---|---|
| SEQ_ID_NO_287 | PCPL | SNKK | TN- | GGKNVI | GFGEHTDPQI | ISVLRSNNTS | 212 |
| SEQ_ID_NO_288 | PCSE | LQAS | -N- | GKNMI | GFGEHTDPQI | ISVLRSNNTS | 220 |
| SEQ_ID_NO_290 | PCPE | IQAL | -K- | DHNMI | GFGEHTDPQI | ISVLRSNNTS | 220 |
| SEQ_ID_NO_291 | PCPE | VQSL | NG- | TSSNVI | GFGEHTDPQI | ISVLRSNNTT | 219 |
| SEQ_ID_NO_292 | PCPD | LQAL | -K- | GTNMI | GFGEHTDPQI | ISVLRSNNTS | 208 |
| SEQ_ID_NO_293 | PCPE | LQAL | -S- | GRNLI | GFGEHTDPQI | ISVLRSNNTS | 221 |
| SEQ_ID_NO_294 | PCPE | LQAL | -E- | GTNMI | GFGEHTDPQI | ISVLRSNNTS | 210 |
| SEQ_ID_NO_295 | PCPE | LQGL | SSA | GARNVI | GFGEHTDPQI | ISVLRSNNTS | 224 |
| SEQ_ID_NO_296 | PCPE | FQENE | RN- | GRKLV | GFGEHTDPQI | ISVLRSNNAS | 224 |
| SEQ_ID_NO_297 | PCPE | IQEF | -S- | GKNLI | GFGEHTDPQI | ISVLRSNNTS | 215 |
| SEQ_ID_NO_298 | PCPE | LQLQ | -PL- | DNNLI | GFGEHTDPQI | ISVLRSNNTT | 220 |
| SEQ_ID_NO_299 | PCPE | FQEKE | RN- | SGRNLV | GFGEHTDPQI | ISVLRSNSTS | 223 |
| SEQ_ID_NO_300 | PCPE | IQEF | -N- | GSKLV | GFGEHTDPQI | ISVLRSNNTS | 211 |
| SEQ_ID_NO_301 | PCPE | VQAL | -N- | AKNLI | GFGEHTDPQI | ISVLRSNNTS | 222 |
| SEQ_ID_NO_303 | PCSE | LQAL | -S- | GRNLV | GFGEHTDPQI | ISVLRSNGTS | 220 |
| SEQ_ID_NO_305 | PCPE | LPEL | --- | GGNLI | GFGEHTDPQL | SILRSNGTS | 219 |
| SEQ_ID_NO_306 | PCHA | LPEL | --- | DSSLT | GFGEHTDPQL | ISVLRSNNTS | 220 |
| SEQ_ID_NO_308 | PCHA | LQGL | --- | GCSAT | GFGEHTDPQL | ISVLRSNGTS | 217 |
| SEQ_ID_NO_309 | PCRA | LQGL | -P- | GCSAT | GFGEHTDPQL | ISVLRSNGTS | 217 |
| SEQ_ID_NO_310 | PCPL | LQGL | -P- | GCSVT | GFGEHTDPQL | VSVLRSNGTA | 217 |
| SEQ_ID_NO_311 | ACPL | LORL | --- | PSCSVT | GFGEHTDPQL | VSILHSNGTA | 222 |
| SEQ_ID_NO_313 | AS-- | ---- | --- | DSCGVT | GFGEHTDPQL | VSVLRSNGTA | 222 |
| SEQ_ID_NO_314 | ---- | ---- | --- | DRNEL | GFGEHTDPQI | ISVLRSNNAS | 206 |

Figure 5G

| SEQ ID | | | | | | Length |
|---|---|---|---|---|---|---|
| SEQ_ID_NO_287 | GLQINLND- | TSFFENVGDS | GSWSVPPDH | LQVMTNGRFK | 250 |
| SEQ_ID_NO_288 | GLQISLGN- | NSFFINVGDS | GSWSVPPDA | LQVMTNGRFK | 258 |
| SEQ_ID_NO_290 | GLQISLND- | SSFFINVGDS | GSWSVPPDP | LQVMTNGRFK | 258 |
| SEQ_ID_NO_291 | GLQISLRD- | YSFFINVGDS | GTWSVPPDQ | LQVMTNGRFK | 257 |
| SEQ_ID_NO_292 | GFQISLAD- | SSFFINIGDA | GNWSVPPDH | LQVMTNGRFK | 246 |
| SEQ_ID_NO_293 | GLQISLRD- | TSFFINVGDS | GTWSVPPDQ | LQVLTNGRFK | 259 |
| SEQ_ID_NO_294 | GLQICLRD- | SSFFINVGDS | ANWSVPPDQ | LQVMTNGRFK | 248 |
| SEQ_ID_NO_295 | GLQISLPD- | NSFFINVGDS | GSWSVPADS | LQVLTNGRFK | 262 |
| SEQ_ID_NO_296 | GLQISLRD- | DSFFINVGDS | GSWMSVPPDQ | LQVMANGRFK | 262 |
| SEQ_ID_NO_297 | GLEISLRD- | HSFFINVGDS | GSWMSVPPDQ | LQVMTNGRFE | 253 |
| SEQ_ID_NO_298 | GLQIALND- | NSFFINVGDS | GHWSVPPDP | LQVMTNGRFK | 258 |
| SEQ_ID_NO_299 | GLLIKN- | ESFFVNVGDS | GTWSVPPDQ | LQVLTNGRFK | 261 |
| SEQ_ID_NO_300 | GLQICLRD- | SSFFINVGDT | GNWESVPPDQ | LQVMTNGRFK | 249 |
| SEQ_ID_NO_301 | GLEISLRD- | TSFFINVGDA | GTWSVPPDQ | LQVMTNGRFK | 260 |
| SEQ_ID_NO_303 | GLQILLKN- | DSFFINVGDS | GTWSVPPDQ | LQVLTNGRFK | 258 |
| SEQ_ID_NO_305 | GLQICLKE- | DAFFVNVGDS | GSWTVPPDR | LQVLTNGRFK | 257 |
| SEQ_ID_NO_306 | GLQICLTD- | SFFVNVGDS | GQWSVPPDQ | LQVLTNGRFR | 258 |
| SEQ_ID_NO_308 | GLQIYLRD- | DSFFVNVGDS | GHWSVPSDR | LQVLTNGRFK | 255 |
| SEQ_ID_NO_309 | GLQIALQN- | DAFFVNVGDS | GQWSVPPNR | LRVLTNGRFK | 255 |
| SEQ_ID_NO_310 | GLQIALQS- | DSFFVNVGDS | GRWSVPPDR | LQVLTNGRFK | 255 |
| SEQ_ID_NO_311 | GLQIALRD- | DAFFVNVGDS | GRWPVPPDR | LQVLTNGRLK | 260 |
| SEQ_ID_NO_313 | GLQVALHD- | | GRWSVPPDR | LQVMTNGRFR | 262 |
| SEQ_ID_NO_314 | GLEIALKDDG | SSFFITVDDC | GTWTQVPADP | LQVMTNGRER | 244 |

Figure 5H

| SEQ_ID_NO | Sequence | | | | Length |
|---|---|---|---|---|---|
| SEQ_ID_NO_287 | SVRHRVLANC | -KKSRVSMIY | FAGPSL TQRI | APLTCL DNE | 289 |
| SEQ_ID_NO_288 | SVRHRVLANS | -LKSRI SMIY | FGGPPLNEKI | APLPSLVELG | 296 |
| SEQ_ID_NO_290 | SVRHRVLANS | -LKARI SMIY | FGGPPLREKI | APLPSLMELG | 296 |
| SEQ_ID_NO_291 | SVKHRVLTNS | -VKSRLSMIY | FGGPPLSEKI | APLPSLMRGD | 296 |
| SEQ_ID_NO_292 | SVKHRVLADD | -SKSRVSMIY | FGGPPLSEKI | APLASLMQGE | 285 |
| SEQ_ID_NO_293 | SVRHRVLTNS | -MKSRI SMIY | FGGPPLSEKI | APFPSLLAEG | 298 |
| SEQ_ID_NO_294 | SVRHRVLANG | -LKSRLSMIY | FGGPPLSEKI | APLPSLMKG- | 286 |
| SEQ_ID_NO_295 | SVRHRVANS | -LKSRLSMIY | FGGPPLSEKI | APLQSVMNGE | 301 |
| SEQ_ID_NO_296 | SVRHRVLSNS | -TKSRVSMIY | FGGPPLSEKI | APLPSLI QGE | 301 |
| SEQ_ID_NO_297 | SVRHRVLADT | -AKSRLSMIY | FGGPPLSEKI | APLPSLMEAE | 292 |
| SEQ_ID_NO_298 | SVRHRVANG | -VKSRLSMIY | FGGPPLSEKI | APLASLME LG | 296 |
| SEQ_ID_NO_299 | SVKHRVLSNS | -MRSRI SMIY | FGGPPLSEKI | APLPSLMQGE | 300 |
| SEQ_ID_NO_300 | SVRHRVLADT | -TKSRVSMIY | FGGPPLSEKI | APLPSVREGG | 288 |
| SEQ_ID_NO_301 | SVKHRVLADP | -VKSRLSMI F | FGGPPLSEKI | APLPSLMEGE | 299 |
| SEQ_ID_NO_303 | SVKHRVLADP | -TKSRLSMIY | FGGPPLOEKI | APLPSLMLKG | 297 |
| SEQ_ID_NO_305 | SVKHRVANG | -LKPRI SMIY | FGGPAMTQRI | APLPSLMAER | 296 |
| SEQ_ID_NO_306 | SVKHRVANS | -LKSRVSMIY | FGGPALTQRI | APLLMGEG | 297 |
| SEQ_ID_NO_308 | SVKHRVVANS | -LKSRVSMIY | FGGPPLAQRI | APLPQLLGAG- | 294 |
| SEQ_ID_NO_309 | SVKHRVVANS | -LKSRVFMIY | FGGPPLAQRI | APLPQLLREG | 294 |
| SEQ_ID_NO_310 | SVKHRVAGS | GLKSRVSMIY | FAGPAPAQRI | APLPQLLGEG- | 294 |
| SEQ_ID_NO_311 | SVRHRVVANS | -LKPRVSMIY | FGGPPLSEKI | APLPQVLGHG- | 299 |
| SEQ_ID_NO_313 | SVKHRVITES | -LKERLSMIY | FGGPPLSEKI | APSTSLMQG- | 301 |
| SEQ_ID_NO_314 | | | | | 282 |

Figure 5I

| SEQ ID NO | Sequence | Number |
|---|---|---|
| SEQ_ID_NO_287 | K- - - -NL- - - - - - - - - - - - - - - - - - - - - - -LN | 329 |
| SEQ_ID_NO_288 | - - - - - - - - - - - - - - - - - - - - - - - - - - - -AT | 332 |
| SEQ_ID_NO_290 | - - - - - - - - - - - - - - - - - - - - - - - - - - - -AS | 332 |
| SEQ_ID_NO_291 | - - - - - - - - - - - - - - - - - - - - - - - - - - - -AS | 332 |
| SEQ_ID_NO_292 | - - - - - - - - - - - - - - - - - - - - - - - - - - - -AS | 321 |
| SEQ_ID_NO_293 | - - - - - - - - - - - - - - - - - - - - - - - - - - - -NL | 339 |
| SEQ_ID_NO_294 | - - - - - - - - - - - - - - - - - - - - - - - - - - - -AS | 322 |
| SEQ_ID_NO_295 | - - - - - - - - - - - - - - - - - - - - - - - - - - - -AS | 337 |
| SEQ_ID_NO_296 | - - - - - - - - - - - - - - - - - - - - - - - - - - - -AT | 337 |
| SEQ_ID_NO_297 | - - - - - - - - - - - - - - - - - - - - - - - - - - - -AS | 328 |
| SEQ_ID_NO_298 | - - - - - - - - - - - - - - - - - - - - - - - - - - - -AS | 332 |
| SEQ_ID_NO_299 | - - - - - - - - - - - - - - - - - - - - - - - - - - - - - | 321 |
| SEQ_ID_NO_300 | - - - - - - - - - - - - - - - - - - - - - - - - - - - -AS | 324 |
| SEQ_ID_NO_301 | - - - - - - - - - - - - - - - - - - - - - - - - - - - -TS | 335 |
| SEQ_ID_NO_303 | - - - - - - - - - - - - - - - - - - - - - - - - - - - -AD | 333 |
| SEQ_ID_NO_305 | - - - - - - - - - - - - - - - - - - - - - - - - - - - -GQ | 332 |
| SEQ_ID_NO_306 | - - - - - - - - - - - - - - - - - - - - - - - - - - - - - | 329 |
| SEQ_ID_NO_308 | - - - - - - - - - - - - - - - - - - - - - - - - - - - - - | 326 |
| SEQ_ID_NO_309 | - - - - - - - - - - - - - - - - - - - - - - - - - - - - - | 326 |
| SEQ_ID_NO_310 | - - - - - - - - - - - - - - - - - - - - - - - - - - - - -K | 327 |
| SEQ_ID_NO_311 | AAGH- - - - - - - - - - - - - - - - - - - - - - - - - -HVS | 341 |
| SEQ_ID_NO_313 | - - - - - - - - - - - - - - - - - - - - - - - - - - - - -Q | 334 |
| SEQ_ID_NO_314 | - - - - - - - - - - - - - - - - - - - - - - - - - - - -PS | 317 |

Figure 5J

| SEQ_ID_NO | | | | | | |
|---|---|---|---|---|---|---|
| SEQ_ID_NO_1429 | MS-E | N- | -- | -- | -- | 12 |
| SEQ_ID_NO_1430 | M- | -- | -- | -- | -- | 7 |
| SEQ_ID_NO_1431 | MPQA- | -- | -- | TSYAG- | -- | 9 |
| SEQ_ID_NO_1432 | MKH- | -D- | PA- | TSYAG- | -K | 12 |
| SEQ_ID_NO_1433 | MSPS- | -F | --H- | -K- | -- | 15 |
| SEQ_ID_NO_1434 | MLVK- | -- | VMNF- | -- | -- | 13 |
| SEQ_ID_NO_1435 | MANP- | -S- | -L- | NMWDQ- | -- | 19 |
| SEQ_ID_NO_1436 | MDHF- | -N- | AT- | PSSI- | PSWMERLD- | ELLEAPWAF | 34 |
| SEQ_ID_NO_1437 | MARNL | TVMAA | LAGPESNTSI | PSWAQLPQLK | TSL-EWLGIK | NSFTGSHWAH | 35 |
| SEQ_ID_NO_1438 | MANP- | -S- | QI- | TGSL- | PSWAQLPQLK | KVIAMPFTN | 19 |
| SEQ_ID_NO_1439 | MAVQ- | -Q- | AT- | PSSI- | PSWMERLD- | -- | 12 |
| | | | LI- | TLEFG- | | |

| SEQ_ID_NO | | | | | | |
|---|---|---|---|---|---|---|
| SEQ_ID_NO_1429 | -- | -S- | QLL- | PFYIA | FVFTLVPWA | -RF-SWLEL | 39 |
| SEQ_ID_NO_1430 | -- | -SP | QPL- | SFYVA | -FTLVPWA | -RF-SWPKL | 34 |
| SEQ_ID_NO_1431 | -- | MMP | -PGVGVYFT | VLL-S | VLW- -AAT | -YI-ASSLL | 36 |
| SEQ_ID_NO_1432 | -CS- | WSKDSP | -LY-GF- | N-VTA | LVI- -LGS | VTFI PKCGR | 44 |
| SEQ_ID_NO_1433 | LNS- | TASASN | -PP- | SYEVA | AALALAVAA | LYL-SFPSQ | 42 |
| SEQ_ID_NO_1434 | IKS- | TDPSA | -RL- | SYLVT | PLI-A-TVAC | FF- -FT | 43 |
| SEQ_ID_NO_1435 | TG- | LSELHP | TPF- | LCLIA | AFLLAVVYS | -LQ- -GP | 50 |
| SEQ_ID_NO_1436 | -- | MTTLWG | TGF- | PWVVT | TLI-I -GL | VHL- -TR | 62 |
| SEQ_ID_NO_1437 | D-S- | TDPSA | PV- | SYLVT | GLIAFICILA | LVQ- -EE | 64 |
| SEQ_ID_NO_1438 | -- | HTFPADS | TSW- | PFVIA | AFLLAVVYS | -LQ- -GP | 50 |
| SEQ_ID_NO_1439 | -- | -- | -- | -- | VLLV-FFVLT | TRN-FFSST | 43 |

Figure 6A

| SEQ_ID_NO | | | | | |
|---|---|---|---|---|---|
| SEQ_ID_NO_1429 | ----RKG-SV | VPLANPPDSL | -FGTGKTRRS | FVKLSREILA | 73 |
| SEQ_ID_NO_1430 | ----RKG-SV | VPLANPPESL | -FGTGKTRRS | FVKLSREILA | 68 |
| SEQ_ID_NO_1431 | RWSLDSLKH- | LPIVNNKEWY | SLSGRKAKLR | FLAESKSLLE | 75 |
| SEQ_ID_NO_1432 | ----RSAF-DA | LPIVNKPKFG | PIFSILARWR | FIHQSKKILE | 80 |
| SEQ_ID_NO_1433 | ----RAHLKH | LPLLNPSKGL | PLFNIESKRE | FVFNSKELLA | 78 |
| SEQ_ID_NO_1434 | ----SK--PN | APCLNPQGFF | DIASGRAKKQ | FLFGLRSMLA | 77 |
| SEQ_ID_NO_1435 | ----RFPLKN | KHLNPKGPL | EFSDTRPKKE | FVYGSRQMLA | 85 |
| SEQ_ID_NO_1436 | ----GPKPLTV | LPVVNPPGTF | ELTANRVKKE | WLVDARQIIR | 98 |
| SEQ_ID_NO_1437 | ----DFPHTD | YPLQNPRKFW | DVTAWKSKWD | FIFGVRKILE | 100 |
| SEQ_ID_NO_1438 | ----RFPLKN | KHLNPKGPL | EFSDTRPKKE | FVHGSRPMLA | 85 |
| SEQ_ID_NO_1439 | ----KAA-GH | LPLVNPPKFY | DIGAIWAKID | CLHARRLLA | 78 |

| SEQ_ID_NO | | | | | |
|---|---|---|---|---|---|
| SEQ_ID_NO_1429 | KARSLFPNEP | FRLI--TDWGE | VLILPPDFAD | EIRNDPRLSF | 112 |
| SEQ_ID_NO_1430 | KARNLFPDEP | FRLI--TDWGE | VLILPPEFAD | EIRNDPRLSF | 107 |
| SEQ_ID_NO_1431 | EARKRYPQQP | FRILSNWGV | LLVLPSCFAD | EIRNDQRLSF | 114 |
| SEQ_ID_NO_1432 | EGQKCYSNRP | FRIMW-TDWGE | VLMLTPDYAH | EIRNDPHLSF | 119 |
| SEQ_ID_NO_1433 | KGRKLFPKSP | YRMI--TDLGE | IVFLPVEQTD | EIRNDPRLSF | 117 |
| SEQ_ID_NO_1434 | TWFDANPHKP | ASVF-SDLGP | MTVLPPSMAN | EIRSDPRLSF | 116 |
| SEQ_ID_NO_1435 | NWFKANPNKP | CRVI--SDFGE | AIVLPPRMAN | EIKNDDRLSF | 124 |
| SEQ_ID_NO_1436 | RGFEKFPGKP | FNMIAADVGL | TTVLPPEYAS | EIRNNPSLSF | 138 |
| SEQ_ID_NO_1437 | KRIAEAPDQP | YRIL--TDFGD | MTILPPDYAN | EIRNSDDLSF | 139 |
| SEQ_ID_NO_1438 | NWFKANPNKP | CRVI--SDFGE | AIVLPPRMAN | EIKNDDRLSF | 124 |
| SEQ_ID_NO_1439 | RGIV--SSGRP | FRLL--TDLGE | MIVLPAHFAIT | EIRSDPRLSF | 115 |

Figure 6B

| SEQ_ID_NO_1429 | SKAAMQDNHA | GIPGFETVAL | VGREDQLIQK | VARKQLTKHL | 152 |
|---|---|---|---|---|---|
| SEQ_ID_NO_1430 | SKAAMQDNHA | GIPGFETVAL | VGREDDQLIQK | VARKQLTKHL | 147 |
| SEQ_ID_NO_1431 | SKAALQDSHG | HIPGLETVKL | VARDDQLIQT | VARKHLTKHL | 154 |
| SEQ_ID_NO_1432 | SGAVKIDGHA | DIPGFETVKL | LSHPDNLIQL | VARKQLTRHL | 159 |
| SEQ_ID_NO_1433 | GSIAFGEDFHG | HLPGFQGAAV | DSYDDAVLQT | LVRKQLTKCI | 157 |
| SEQ_ID_NO_1434 | VEFSAKEFHT | SIPGFEAFNE | GTRDESITLT | VINKDLTKRL | 155 |
| SEQ_ID_NO_1435 | TRWTYKAFHG | HLPGFEGFGE | ASRESHIVQE | VIMRDLTKYL | 164 |
| SEQ_ID_NO_1436 | VAFMAHLFFS | ELPGFEPTRE | GMFDNDIGIT | VVHKYLTVNL | 178 |
| SEQ_ID_NO_1437 | DRVVEKNFQA | HLPGLDVFKE | ENLHKTVLRH | VIRTRLTQFL | 179 |
| SEQ_ID_NO_1438 | TRWTYKAFHG | HLPGFEGFGE | VSRESHIVQE | VIMRDLTKYL | 164 |
| SEQ_ID_NO_1439 | AEVIEQNFHS | RFPGFEGFRM | GTTDAHLSRD | LANNQLTHTL | 155 |

| SEQ_ID_NO_1429 | SAVIEPLSRE | STLAVSLNFG | E--TTEWRAI | RLKPAILDII | 190 |
|---|---|---|---|---|---|
| SEQ_ID_NO_1430 | SI-------- | ---------- | ---------- | ----LDII-- | 153 |
| SEQ_ID_NO_1431 | AKVIQPLSEE | TEFALDQNFG | H--NL----- | ---PAILDII | 183 |
| SEQ_ID_NO_1432 | AAVIQPLSSV | TEEALTKNLG | KL-SQEWSEI | YLKYAVLDLI | 197 |
| SEQ_ID_NO_1433 | AQIIEPVSAE | AAQALADKFG | DL-SEDWREM | EVKSVVLDTV | 195 |
| SEQ_ID_NO_1434 | AQVTQPLAEE | TTLAMQEIFT | DL-NKEWHLI | NVREKILHLV | 193 |
| SEQ_ID_NO_1435 | NKVTEPLSRE | TSMAMEANLP | KAANGEWSTI | NLRSKILPIV | 204 |
| SEQ_ID_NO_1436 | ARITEPLSRE | ATAALKDIFT | D--NSEWHDA | NLKAINLALV | 216 |
| SEQ_ID_NO_1437 | SKVTAPLSNE | TALTLQDVFT | D--QKEWHTI | ILKDEIVKIV | 217 |
| SEQ_ID_NO_1438 | NKVTEPLAQE | TSMAMEAILP | KAANGEWSTI | NLRSKILPIV | 204 |
| SEQ_ID_NO_1439 | AKVTEALSEE | CIAAMTDHFP | A--TKEWAEI | CLREHVLQLV | 193 |

Figure 6C

| SEQ_ID | | | | | | |
|---|---|---|---|---|---|---|
| SEQ_ID_NO_1429 | ARISSRIYLG | DQLCRNEAWL | KITKTYTTNF | YTASTNLRMF | 230 |
| SEQ_ID_NO_1430 | ARISSRIYLG | DQLCRNEAWL | KLTKTYTTNF | YTASTNLRMF | 193 |
| SEQ_ID_NO_1431 | ARISSRIYLG | DELCRNTAWL | ATTKVYTSAF | FAAPVKLGLI | 223 |
| SEQ_ID_NO_1432 | ARLSARVFLG | EDLYQNEEWL | SLVKNYATHF | FTASSDLRKV | 237 |
| SEQ_ID_NO_1433 | ARISSRVFLG | EELCRNEDWL | RATKEYTVNF | FVAGTHLRMI | 235 |
| SEQ_ID_NO_1434 | ARISSRVFLG | EELCRDEAWL | KITREHAMNG | FVAADLLRAW | 233 |
| SEQ_ID_NO_1435 | ARLSSRVFLG | EELCRNEEWL | KVTQQYTIDG | EGAAEDLRLW | 244 |
| SEQ_ID_NO_1436 | ARISSRIFLG | EELCRNEEWL | KITVNYTVDV | MKAAERLRRV | 256 |
| SEQ_ID_NO_1437 | SRISARVFLG | EDLCRNPEWQ | KITADYAMTC | FLAADMVRMF | 257 |
| SEQ_ID_NO_1438 | ARISSRVFLG | EELCRNVEWL | KVTQQYTIDG | FGAAEDLRLW | 244 |
| SEQ_ID_NO_1439 | ARLSSRVFLG | DAGANNSAWL | RITTEYTKTA | YIAAYLLRLW | 233 |

| SEQ_ID | | | | | | |
|---|---|---|---|---|---|---|
| SEQ_ID_NO_1429 | PRSIRPLAHW | FLPECRKLRQ | ERKDAIGIIT | PLIERRRELR | 270 |
| SEQ_ID_NO_1430 | PRSIRPLAHW | FLPECRKLRQ | ERKDAVGIIT | PLIERRRELR | 233 |
| SEQ_ID_NO_1431 | PAPLRRLAHW | LIPECKILRE | QVQEARRIIE | PLVRRRQALR | 263 |
| SEQ_ID_NO_1432 | PWAFRSLVHW | FVPSCRALRL | ERYNARRVLE | PVISQRRQLK | 277 |
| SEQ_ID_NO_1433 | PRPLRRVLHW | FVPKCRELRA | SFDEARRIIG | PVPYIEKRRAAR | 275 |
| SEQ_ID_NO_1434 | PEALRPVVSM | FMPHCRTARS | QIREAEKIIG | PPVISKRREAK | 273 |
| SEQ_ID_NO_1435 | PAALRPIVHW | FLPSCQRARA | DVRVARSILD | PVLKKRRQEK | 284 |
| SEQ_ID_NO_1436 | PGPLRRIVHW | FLPEAQKCRD | EVKRAGKVIR | PVLEKRRREK | 296 |
| SEQ_ID_NO_1437 | PKPIRPLVHR | ILPLSIKVRS | DVKKARAIVE | PVLAERKKIK | 297 |
| SEQ_ID_NO_1438 | PAALRPIVHW | FLPSCQRARA | DVRVARSILD | PVLKKRRQEK | 284 |
| SEQ_ID_NO_1439 | PPVLRPFVHW | FIPHCRKLRA | QVAEARHLIV | GLIEQRHQGR | 273 |

Figure 6D

| | | | | | |
|---|---|---|---|---|---|
| SEQ_ID_NO_1429 | RAAI AAGQPL | PVFHDAI DWS | EQEAEAAGTG | ASFDPVI FQL | 310 |
| SEQ_ID_NO_1430 | RAAI AAGQPL | PVFHDAI DWS | EQEAEAAGSG | SAFDPVI FQL | 273 |
| SEQ_ID_NO_1431 | AKALAEGCPT | PQFNDALGWA | AEESA- -KNG | KDYDPAI TQL | 301 |
| SEQ_ID_NO_1432 | EAAKTAGGTP | LHFEDAI EWA | EVEAR- -VKG | TKYDPVI FQL | 315 |
| SEQ_ID_NO_1433 | AAALAAGKKI | PEFHDAI DWA | DQEAA- -ARG | VTYDPAI LQL | 313 |
| SEQ_ID_NO_1434 | DAALRAGREA | PHNDAI EWF | EQAS- - -KG | KPYNPALSQL | 309 |
| SEQ_ID_NO_1435 | AAN- -GG- -K | AEHDDAI EWF | ERTA- - -KG | KYYDPAVAQL | 316 |
| SEQ_ID_NO_1436 | ATMESEGKEA | LQYNDAI EWF | EQMAK- -SQG | TSYDPEVVQL | 334 |
| SEQ_ID_NO_1437 | EEARRRGEPI | PKFDDAI EWC | EELE- - - -A | VGFDMATFQL | 333 |
| SEQ_ID_NO_1438 | AAN- -GG- -K | AQHDDAI EWF | ERTA- - - -QD | EYYDPAVAQL | 316 |
| SEQ_ID_NO_1439 | VAAELASQPV | PQYNDAI EWF | EQDFAV- TRD | GRHDPAVAQL | 312 |

| | | | | | |
|---|---|---|---|---|---|
| SEQ_ID_NO_1429 | TLSLLAI HTT | YDLLQQTMI D | LGRHPEYI EP | LRQEVVQLLR | 350 |
| SEQ_ID_NO_1430 | TLSLLAI HTT | YDLLQQTMI D | LGRHPEYI EP | LRQEVVQLLR | 313 |
| SEQ_ID_NO_1431 | ALSMLAI HTT | YDLFQQCI LD | LAQNPHFI EP | LRQEAI EVI Q | 341 |
| SEQ_ID_NO_1432 | TLSLLAI HTT | YDLLEMCMI D | LAKRPDCI ED | LRKEVI TVLR | 355 |
| SEQ_ID_NO_1433 | MLAVAAI HTT | ADLVTEI VLQ | LAHPEHFGP | LRGEVLHI L L | 353 |
| SEQ_ID_NO_1434 | FLSTVAI HTT | TDLLCQTMI D | ARHPEYFEP | LREEVTRVLA | 349 |
| SEQ_ID_NO_1435 | VLSLVAI HTT | SDLTCQVMTN | LMQNPEFI AP | LREEMI QVLS | 356 |
| SEQ_ID_NO_1436 | FLSTVAI HTT | SDLTVMAD LLD | LARNPEL EP | LREEI SSVLR | 374 |
| SEQ_ID_NO_1437 | AMAVAAI HTT | SDFLTQI LLD | LAQHPEYI EP | LRAEI AAVLK | 373 |
| SEQ_ID_NO_1438 | VLSLVAI HTT | SDLTCQVMTN | LMQNPEFI GP | LREEMI RVLS | 356 |
| SEQ_ID_NO_1439 | LLAQAAI ETT | TDLLTQVI LD | LAQHPEL GT | LREEVAGAI Q | 352 |

Figure 6E

| SEQ_ID_NO | Sequence | | | | | Pos |
|---|---|---|---|---|---|---|
| SEQ_ID_NO_1429 | EEGWKKTTLF | KMKLLDSAIK | ESQRMKPGSI | VTMRRYVTED | | 390 |
| SEQ_ID_NO_1430 | EEGWKKTTLF | KMKLLDSAIK | ESQRMKPGSI | VTMRRYVTED | | 353 |
| SEQ_ID_NO_1431 | QYGWTKQGLY | HMKLLDSALK | ETQRLKPGSM | VTMRRYVLED | | 381 |
| SEQ_ID_NO_1432 | KDGWTKNALY | NMKLLDSALK | ESQRLKPGSI | TSMRRYATSD | | 395 |
| SEQ_ID_NO_1433 | SEGLKKSSLH | NMKLLDSVVK | EAQRHKPPGV | ASLRRRVEKP | | 393 |
| SEQ_ID_NO_1434 | QDGWKKTSLH | SMQLLDSVLK | ESQRLKPLQL | ASMQRLAVKD | | 389 |
| SEQ_ID_NO_1435 | EGGWKKTSLY | NMKLLDSVLK | ESLRLKPIAV | ASMRRYAEKD | | 396 |
| SEQ_ID_NO_1436 | DGGWKKTSLY | DMKLLDSVLK | ETQRLRPIGL | VSMRRVAMDH | | 414 |
| SEQ_ID_NO_1437 | EDGWDKLSLY | KMRLLDSVCK | ETQRLKPIAV | VAMHREALKD | | 413 |
| SEQ_ID_NO_1438 | EGGWKKTSLY | NMKLLDSVIK | ESQRVKPIGV | ASMRRYAEKD | | 396 |
| SEQ_ID_NO_1439 | EGGWRKSSLY | DMKLLDSVLK | ESQRLKPLAM | TSMHRLVEE | | 392 |
| SEQ_ID_NO_1429 | ITLSSGLTLK | KGTRLNVDNR | RLDDPKIYDN | PEVYNPYRFY | | 430 |
| SEQ_ID_NO_1430 | ITLSSGLTLQ | KGTRLNVDNR | RLDDPKIYEN | PEVYNPYRFY | | 393 |
| SEQ_ID_NO_1431 | LQLSNGLLK | KGTRINIDTQ | RMRDPDLHED | PLKYDAFRFY | | 421 |
| SEQ_ID_NO_1432 | VQLRDGVLK | KGNRLNVLTL | H-RSPDLFPS | PDTYDPYRFY | | 434 |
| SEQ_ID_NO_1433 | LTLSNGLNLK | LGDRLAIDTY | RMGDPELHQD | PETWDPYRFL | | 433 |
| SEQ_ID_NO_1434 | VQLSDGTFIP | KGTASCVSSH | ALWDPDVYEA | PDTWDGHRFL | | 429 |
| SEQ_ID_NO_1435 | VTLSDGTFIP | KGGFVAVSAH | DMWNSEVYEQ | AEKWDGRRFL | | 436 |
| SEQ_ID_NO_1436 | LKLSDGTFLP | KGTKMAVSSH | RMWDPDVYEN | PEQWDGFRYV | | 454 |
| SEQ_ID_NO_1437 | IDLAGGVHLP | KGTRIAISSH | RMRDPAYYPS | PNEYDGYRFL | | 453 |
| SEQ_ID_NO_1438 | VTLSDGTFIP | KGGFVAVSAH | DMWNSEVYEQ | ADKWDGRRFL | | 436 |
| SEQ_ID_NO_1439 | LTLSDGTLP | KGSVLGVSAD | RMWNPSVHEN | PAQFDGFRFQ | | 432 |

Figure 6F

| | | | | | |
|---|---|---|---|---|---|
| SEQ_ID_NO_1429 | DMRSEA-GK | DHGAQLVSTG | SNHMGFGHGQ | HSCPGRFFAA | 468 |
| SEQ_ID_NO_1430 | DMRSEA-GK | DHGAQLVSTG | SNHMGFGHGQ | HSCPGRFFAA | 431 |
| SEQ_ID_NO_1431 | KMRQQP-GG | EHTAQLVSTS | PDHLGFGHGE | HSCPGRFFAA | 459 |
| SEQ_ID_NO_1432 | NIRGQP-GK | ENWAQLVSTS | VEHMGFGHGE | HSCPGRFFAA | 472 |
| SEQ_ID_NO_1433 | RMAEQP-GK | ANYAQLVMTS | PDHLAFGHGD | HACPGRFFAA | 471 |
| SEQ_ID_NO_1434 | RQRGIPL- | ENFSQLVSTS | ENHLGFGHGK | HACPGRFFAA | 467 |
| SEQ_ID_NO_1435 | RMRETPGAGK | ENVAQLVSTA | PEHLGFGHGQ | HACPGRFFAA | 476 |
| SEQ_ID_NO_1436 | NLRETP-GQ | DKHAQFVSTS | ERHLGFGHGK | HACPGRFFAS | 492 |
| SEQ_ID_NO_1437 | RMRDELGAGK | DGDAHFVTTS | PQHLGFGHGQ | HACPGRFFAS | 493 |
| SEQ_ID_NO_1438 | RMRETPGAGK | ENAAQLVSTA | PEHLGFGHGQ | HACPGRFFAA | 476 |
| SEQ_ID_NO_1439 | RMRDQPGFGS | TNQAHLVSTS | VNHLAFGHGK | HACAGRFFVA | 471 |

| | | | | | |
|---|---|---|---|---|---|
| SEQ_ID_NO_1429 | NEIKVALCHI | LVKYDWKLCP | DT-ETKPDTR | GMIAKSSPVT | 507 |
| SEQ_ID_NO_1430 | NEIKVALCHI | LVKYDWKLCP | DT-ETKPDTR | GMIAKSSPVT | 470 |
| SEQ_ID_NO_1431 | NEIKVAMAHM | LKYEWKPAG | HS-SAGPDVK | GLLMKSGAGA | 498 |
| SEQ_ID_NO_1432 | NEIKVALAHI | LVKYDWKLSD | EA-GGCTEVK | GMVEIKAGSKV | 511 |
| SEQ_ID_NO_1433 | YEIKIMCHL | LKYEWEALP | AIT-DVSPMVL | GFTNASNPTA | 510 |
| SEQ_ID_NO_1434 | NEIKIALAHL | LEYEWRLPE | GE-ALDVEDF | GITPLMNQTL | 506 |
| SEQ_ID_NO_1435 | NEIKIALVHL | LNYEWRLPE | GS-DPKIRTF | GFSMGVDPSL | 515 |
| SEQ_ID_NO_1436 | SELKVALCHI | LMKYDFELAP | GT-VIVQHRYS | GASYYADPAI | 531 |
| SEQ_ID_NO_1437 | NEVKVALCHI | LKYNWRLAP | GV-EPKIFQF | GLTGCDPVA | 532 |
| SEQ_ID_NO_1438 | NEIKIALVHL | LNYEWRLPE | GS-DPKIRTF | GFSMGVDPSL | 515 |
| SEQ_ID_NO_1439 | HEAKIALTHL | LKYDWKLAS | TSANAKPMEE | GLVLQANPKA | 511 |

Figure 6G

| SEQ ID | Sequence | | End |
|---|---|---|---|
| SEQ_ID_NO_1429 | DI LI KRRESV | E------------LDLEAI | 524 |
| SEQ_ID_NO_1430 | DI LI KRRGSV | E------------LDLEAI | 487 |
| SEQ_ID_NO_1431 | QI DI RRRETV | E--------------LA | 511 |
| SEQ_ID_NO_1432 | KI LVRQRQDV | E------------SVLDEA | 528 |
| SEQ_ID_NO_1433 | RVRVRRRKHV | E------------LDMDCL | 527 |
| SEQ_ID_NO_1434 | KMEFRKRD- | ------------- | 514 |
| SEQ_ID_NO_1435 | KVEYKGRQPE | I------------EL | 528 |
| SEQ_ID_NO_1436 | RVML RRRNVA | LEALAGKEEI PSWFER | 548 |
| SEQ_ID_NO_1437 | KVEI RRRDYH | L------------DVRDLPVK | 560 |
| SEQ_ID_NO_1438 | KVEYKGRQPE | I------------EL | 528 |
| SEQ_ID_NO_1439 | KI CLRGRQEL | S------------KSPF | 526 |

Figure 6H

| | | | | | |
|---|---|---|---|---|---|
| SEQ_ID_NO_1542 | MPHKDNLLES | PVGKSVTATI | AYHSGPALPT | SPIAGVTTLQ | 40 |
| SEQ_ID_NO_1543 | MPHKDTPLES | PVGKNVTATI | AYHSGPALPT | SPIAGVTTLQ | 40 |
| SEQ_ID_NO_1544 | MPHKDTPLEQ | PVGKNVTATI | AYHSGPALPT | SPIAGVTTLQ | 40 |
| SEQ_ID_NO_1545 | MSQQDTHHEP | PVGKNVTATI | AYHSGPALPT | SPIAGVTTLE | 40 |
| SEQ_ID_NO_1542 | DCTQQAVAVT | DIRPSVSSFT | LDGNGFQVVK | HTSAVGSPPY | 80 |
| SEQ_ID_NO_1543 | DCTQQVVAVT | DIRPSVSSFT | LDGNGFQVVK | HASAVGSPPY | 80 |
| SEQ_ID_NO_1544 | DCTQQVVAVT | DIRPSVSSFT | LDGNGFQVVK | HTSVVGSPPY | 80 |
| SEQ_ID_NO_1545 | DCTQQLVAVT | DIRPSVSSFT | LDGNGFQVVK | HTSAVSSPPY | 80 |
| SEQ_ID_NO_1542 | DHSSWTDPVV | RKEVYDPEII | ELAKSLTGAK | KVMILLASSR | 120 |
| SEQ_ID_NO_1543 | NHSSWTDPVV | RKEVYDPEII | ELAKSLTGAK | KVMILLASSR | 120 |
| SEQ_ID_NO_1544 | DHSSWTDPVV | RKEVYDPEII | ELAKSLTGAK | KVMILLASSR | 120 |
| SEQ_ID_NO_1545 | DHSSWTGPVV | RKEVYDPEII | ELAKSVTGAK | KVMILLASSR | 120 |
| SEQ_ID_NO_1542 | NVPFKEPELA | PPYPMPGKSS | SGSKERE--- | -AIPANELPT | 156 |
| SEQ_ID_NO_1543 | NVPFKEPELA | PPYPMPGKSN | SGSKEGG--- | -ANPANELPT | 156 |
| SEQ_ID_NO_1544 | NVPFKEPELA | PPYPMPSKSN | KGSKEEV--- | -AKPTDELPT | 156 |
| SEQ_ID_NO_1545 | NVPFKEPELA | PPYPMPSKSS | NGCNGGETGP | AVRPQHELPT | 160 |
| SEQ_ID_NO_1542 | TRAKGFQKGE | EEGPVRKPHK | DWGPSGAWNT | LRNWSQELID | 196 |
| SEQ_ID_NO_1543 | TRAKGFQKGE | EEGPVRKPHK | DWGPSGAWNT | LRNWSQELID | 196 |
| SEQ_ID_NO_1544 | TRAKGFQKGE | EEGPVRKPHK | DWGPSGAWNT | LRNWSQELID | 196 |
| SEQ_ID_NO_1545 | TRAKGFQKGE | EEGPVRKPHK | DWGPSGAWNT | LRNWSQELID | 200 |
| SEQ_ID_NO_1542 | EAGDIIKAGD | EAAKLPGGRA | KNYQGRRWAL | YTTWRPLKTV | 236 |
| SEQ_ID_NO_1543 | EAGDIIKAGD | EAAKLPGGRA | KNYQGRRWAL | YTTWRPLKPV | 236 |
| SEQ_ID_NO_1544 | EADDIIKAGD | EAAKLPGGRA | KNYQGRRWAL | YTPMRPLKPV | 236 |
| SEQ_ID_NO_1545 | EAGDIIKAGD | VAAELPGGRA | KNYQGRRWAL | YTTWRPLKPV | 240 |

Figure 7A

| | | | | | |
|---|---|---|---|---|---|
| SEQ_ID_NO_1542 | KRDPMAYVDY | WTADEEDGVS | FWRNPPGVHG | TFESDVLLTK | 276 |
| SEQ_ID_NO_1543 | KRDPMAYVDY | WTADGEDGVS | FWRNPPGVHG | TFESDVLLTK | 276 |
| SEQ_ID_NO_1544 | KRDPMAYVDY | WTADDEDGVS | LWRNPPGVHG | TFESDVLLTK | 276 |
| SEQ_ID_NO_1545 | KRDPMAYVDY | WTADEQDGVS | FWRNPPGVHG | TFESDVLLTK | 280 |

| | | | | | |
|---|---|---|---|---|---|
| SEQ_ID_NO_1542 | ANPKHKWWYW | SDQTPDEVLL | MKIMDTESEK | DGSEIAGGVH | 316 |
| SEQ_ID_NO_1543 | ANPKHKWWYW | SDQTPDEVLL | MKIMDTESEK | DGSDGIAGGVH | 316 |
| SEQ_ID_NO_1544 | ANPKHKWWYW | SDQTPDEVLL | MKIMDTESEK | DGSDIAGGVH | 316 |
| SEQ_ID_NO_1545 | ANPKHKWWYM | SDQTPDEVLL | MKIMDTESEK | DGSDVAGGVH | 320 |

| | | | | |
|---|---|---|---|---|
| SEQ_ID_NO_1542 | HCSFHLPGTE | KEEVRESIET | KFIAFW | 342 |
| SEQ_ID_NO_1543 | HCSFHLPGTE | KEEVRESIET | KFIAFW | 342 |
| SEQ_ID_NO_1544 | HCSFHLPGTE | KEEVRESIET | KFIAFW | 342 |
| SEQ_ID_NO_1545 | HCSFHLPGTE | DEEVRESIET | KFIAFW | 346 |

Figure 7B

| | | | | | | |
|---|---|---|---|---|---|---|
| SEQ_ID_NO_1386 | M NHS- -SSY | YYEFYKDHSH | TFRRSMSENT | LI SSCLALAT | | 38 |
| SEQ_ID_NO_1387 | M ANHS- -SSY | YHEFYKDHSH | TVLTLMSEKP | VILPSLILGT | | 38 |
| SEQ_ID_NO_1388 | MATLEPTIGY | IAELIS---- | ----TSNLP | SVTFVMTAVT | | 31 |
| | | | | | | |
| SEQ_ID_NO_1386 | CAILLSI QWL | KPQPLI MVNG | RKFGELSNVR | AKRDFTFGAR | | 78 |
| SEQ_ID_NO_1387 | CAVLLCI QWL | KPQPLI MVNG | RKFGELSNVR | AKRDFTFGAR | | 78 |
| SEQ_ID_NO_1388 | LAVFYTLQRR | KS-TVPLINP | KRWFEFSDYR | IKQEFVHNAI | | 70 |
| | | | | | | |
| SEQ_ID_NO_1386 | QLLEKGFKMS | PDKPFRI MGD | VGELHI LPPK | YAYEVRNNEK | | 118 |
| SEQ_ID_NO_1387 | QLLEKGLKMS | PDKPFRI MGD | VGELHI LPPK | YAYEVRNNEK | | 118 |
| SEQ_ID_NO_1388 | PLVKQGFAAT | GNKPFRI LAD | SGELTVLPPD | VANEIKSNDH | | 110 |
| | | | | | | |
| SEQ_ID_NO_1386 | LSFTMAAFKW | FYAHLPGFEG | FREGTNESHI | MKLVARHQLT | | 158 |
| SEQ_ID_NO_1387 | LSFTMAAFKW | FYAHLPGFEG | FREGTNESHI | MKLVARHQLT | | 158 |
| SEQ_ID_NO_1388 | MSFELSTAKQ | FFGHLPGFEV | FNATGMNTKV | SKSLVQRQLT | | 150 |
| | | | | | | |
| SEQ_ID_NO_1386 | HQLTLVTGAV | SEECALVLKD | VYTDSPEWHD | I TAKDANMKF | | 198 |
| SEQ_ID_NO_1387 | HQLTLVTGAV | SEECALVLKD | VYTDSPEWHD | I TAKDANMKL | | 198 |
| SEQ_ID_NO_1388 | THLNKVTKPL | SDEASLSLQE | LITDNKEWHE | ITLKNEVLQI | | 190 |
| | | | | | | |
| SEQ_ID_NO_1386 | MARI TERVFL | GKEMCRNPQW | LRITSTYAVI | AFRAVEELRL | | 238 |
| SEQ_ID_NO_1387 | MARI TSRVFL | GKEMCRNPQW | LRITSTYAVI | AFRAVEELRL | | 238 |
| SEQ_ID_NO_1388 | ARLSSKVFT | GDELCHDKRW | LDLTVNYTLM | AFAAADSLRM | | 230 |
| | | | | | | |
| SEQ_ID_NO_1386 | WPSWLRPVVQ | WFMPHCTQSR | ALVQEARDLI | NPLLERRREE | | 278 |
| SEQ_ID_NO_1387 | WPSWLRPVVQ | WFMPHCTQSR | ALVQEARDLI | NPLLERRREE | | 278 |
| SEQ_ID_NO_1388 | WPPYLRSLVH | WFLPKCRASR | AEVARARITVI | EPILKRRAEQ | | 270 |

Figure 8A

```
SEQ_ID_NO_1386  KAEAERTGEK  VTYNDAVEW   LDDLAREKGV  GYDPACAQLS  317
SEQ_ID_NO_1387  KAEAERTGEK  VTYNDAVEW   LDDLAREKGV  GYDPACAQLS  317
SEQ_ID_NO_1388  KAALAAQGKK  APEINDAIEW  FTTATTIEGF  TLDPVIAQLG  310

SEQ_ID_NO_1386  LSVAALHSTT  DFFTQVMFDI  AQNPELIEPL  REEIISVLGK  357
SEQ_ID_NO_1387  LSVAALHSTT  DFFTQVMFDI  AQNPELIEPL  REEIAVLGK   357
SEQ_ID_NO_1388  LSLAAIHTTS  DLSTQVIEDI  ASHPEIIEPL  RKEMIESLSE  350

SEQ_ID_NO_1386  QGWSKNSLYN  LKLMDSVLKE  SQRLKPIAIA  SMRRFTTHNV  397
SEQ_ID_NO_1387  QGWSKNSLYN  LKLIDSVLKE  SQRLKPIAIA  SMRRFTTHNV  397
SEQ_ID_NO_1388  GGWKKNSLYK  LKLLDSVIKE  SQRMKPIASI  SMSRLTTTNV  390

SEQ_ID_NO_1386  ELSDGVILPK  NKLTLVSAHQ  HWDPEYYKDP  LKFDGYRFFN  437
SEQ_ID_NO_1387  KLSDGVILPK  NKLTLVSAHQ  HWDPEYYKDP  LKFDGYRFFN  437
SEQ_ID_NO_1388  SLSDGTFLPR  NTATAVSSHR  MWDPSIHTNP  DQWDGYRFYN  430

SEQ_ID_NO_1386  MRREPGKESK  AQLVSATPDH  MGFGYGLHAC  PGRFFASEEI  477
SEQ_ID_NO_1387  MRREPGKESK  AQLVSATPDH  MGFGYGLHAC  PGRFFASEEI  477
SEQ_ID_NO_1388  KRQEPGQENL  SQLVSITSPDH LAFGHGQHAC  PGRFFAANEI  470

SEQ_ID_NO_1386  KIALSHILLK  YDFKPVEGSS  MEPRKYGLNM  NANPTAKLSV  517
SEQ_ID_NO_1387  KIALSHILLK  YDFKPVEGSS  MEPRKYGLNM  NANPTAKLSV  517
SEQ_ID_NO_1388  KVFLCHLLLK  YDCKIVEGSM  IKPFPYSFSM  NANPFAPLM   510

SEQ_ID_NO_1386  RRRKEEIA---   -  526
SEQ_ID_NO_1387  RRRKEEIA---   -  526
SEQ_ID_NO_1388  RRREDVLDLD  ALDA  524
```

| | | | | | |
|---|---|---|---|---|---|
| SEQ_ID_NO_1274 | IKLQRGTSIA | FPAHAIHMSE | ETPTFSPIDF | SSIDFENPSPR | 295 |
| SEQ_ID_NO_1275 | LKLPAGTPIS | FPLWGVYNSS | STNTFSD-AY | NEGTGNAPPT | 413 |
| SEQ_ID_NO_1276 | HTIPKGTRIG | YDAQVLNTAG | PNLSLLPHDP | STMPQLDPPS | 432 |
| SEQ_ID_NO_1277 | HTIPKGTRIC | YDTVSVNMSN | PDLSSIPHDP | SNVTSLDPPT | 431 |
| SEQ_ID_NO_1278 | TLLPKGTHFS | MPSAAILQDN | GV-------- | --EPGAD--- | 484 |
| SEQ_ID_NO_1279 | TLLPKGTHFS | MPSAAILQDN | AV-------- | --EPDAD--- | 428 |

| | | | | | |
|---|---|---|---|---|---|
| SEQ_ID_NO_1274 | IFDGFRYLNL | RSIKGQGSQH | QAATTGPDYL | IFNHGKHACP | 335 |
| SEQ_ID_NO_1275 | EFDGFRFARL | REQPGRETKH | QAATTGPDAF | NFGHGPHACP | 453 |
| SEQ_ID_NO_1276 | VFSPFRFASI | RETPGNESKY | QFVTTSKEAM | NFGHGNHACP | 472 |
| SEQ_ID_NO_1277 | TFSPFRWSSL | RDTPGNESKF | QFVTTSKQSM | NFGHGNHACP | 471 |
| SEQ_ID_NO_1278 | QFDGFRYYKK | RLNPEEANKH | QFAMTDNNNL | HFGHGKYSCP | 524 |
| SEQ_ID_NO_1279 | QFDAFRYYKK | RLNPEEANKH | QFAMTDNNNL | HFGHGKYSCP | 468 |

| | | | | | |
|---|---|---|---|---|---|
| SEQ_ID_NO_1274 | GRFFAISEIK | MILIELLAKY | DFRLE----- | DGKPGPELMR | 370 |
| SEQ_ID_NO_1275 | GRFFAVYVIK | QIEIELLNY- | DRLKGSGGK- | DAGSRPPNTI | 493 |
| SEQ_ID_NO_1276 | GRFFAGVEIK | VILIELLRGW | DFRNVGDTEM | KGGGRPPENFC | 512 |
| SEQ_ID_NO_1277 | GRFFAGLELK | VAIVELLRNW | EFRLVGDEGA | KGGERPKNLV | 511 |
| SEQ_ID_NO_1278 | GRFFASNEIK | IIMAHLLTDY | EFKYP----- | RGATRPRNLT | 559 |
| SEQ_ID_NO_1279 | GRFFASNEIK | IIMAHLLTDY | EFKYP----- | PGASRPRNLT | 503 |

| | | | | | |
|---|---|---|---|---|---|
| SEQ_ID_NO_1274 | VGTETRLDTK | AGLEMRRR-- | ---------- | ------- | 388 |
| SEQ_ID_NO_1275 | RKMIVMPDFG | REVEVRKRTG | ---------- | ----A-- | 514 |
| SEQ_ID_NO_1276 | VDTAINPNPV | AEIEFKRR-- | ---------- | ----V-- | 531 |
| SEQ_ID_NO_1277 | YDVTIMPDPV | GQLEFRRRK- | ---------- | ----F-- | 531 |
| SEQ_ID_NO_1278 | ADENLYPDPS | ARLLMRRRVV | APPQASITPQ | LVSA--- | 593 |
| SEQ_ID_NO_1279 | ADENLYPDPS | ARLLMRRRMV | AEGQAQITPE | IVLV--- | 537 |

TRANSGENIC PLANTS HAVING ALTERED BIOMASS COMPOSITION

CROSS-REFERENCE TO RELATED APPLICATIONS

This application is a National Stage Application under 35 U.S.C. § 371 and claims the benefit of International Application No. PCT/US2012/068756, filed Dec. 10, 2012, which claims priority to U.S. Application Ser. No. 61/568,747, filed Dec. 9, 2011, the disclosures of which are incorporated herein by reference.

TECHNICAL FIELD

This document relates to methods and materials involved in modulating biomass composition in plants. For example, this document provides plants having altered sugar content or conversion efficiency, as well as materials and methods for making plants and plant products having altered sugar content or conversion efficiency.

INCORPORATION-BY-REFERENCE OF SEQUENCE LISTING

The accompanying file, named 116960300WO1SEQLISTING is 2.82 MB. The file can be accessed using Microsoft Word on a computer that uses Windows OS.

BACKGROUND

Plants store energy from sunlight in the form of chemical bonds that compose plants. The energy stored in plant materials can be converted to forms of energy such as heat, electricity and liquid fuels, depending upon the plant material employed and the process applied to extract energy from it. Other processes can produce chemical intermediates from plant biomass that are useful in a variety of industrial processes, for instance lactic acid, succinic acid, etc.

Plant materials have been used for millennia by humans to generate heat by direct combustion in air. For building and process heating purposes, this heat is typically used to generate steam, which is a more transportable heat source used to heat buildings and public areas using heat exchangers of various design. The production of steam may also be used to drive turbines, which transform heat energy into electrical energy. These processes typically involve a simple, direct combustion process of the plant material alone, or a co-firing process with coal or other energy source.

Fuels such as ethanol can be produced from plant materials by a number of different processes. For example, the sucrose in sugarcane can be extracted from the plant material and directly fermented to ethanol using a microorganism, such as brewer's yeast. Brazil has converted a significant portion of its transportation sector over to ethanol derived from sugarcane, proving this can be done on a very large scale over broad geography. As another example, the starch from corn can be processed using α-amylase and glucoamylase to liberate free glucose that is subsequently fermented to ethanol. The US uses a significant portion of its corn crop to produce ethanol from starch. While these advances are significant, the ability to increase the amount of liquid transportation fuel obtained from plant material is limited because only a small fraction of the solar energy captured and transformed into chemical energy in plants is converted into biofuels in these industrial processes.

Plant material can be used for the production of cellulosic biofuels by biochemical processes employing enzymes and/or microorganisms or by thermochemical processes such as Biomass to Liquids (BtL) technology using high temperature and non-enzymatic catalysts. There are also examples of hybrid thermochemical/biochemical processes. Biochemical processes typically employ physical and chemical pretreatments, enzymes, and microorganisms to deconstruct the lignocellulose matrix of biomass in order to liberate the fermentable from cellulose, hemicellulose, and other cell wall carbohydrates, which are subsequently fermented to ethanol by a microorganism. Currently, many different processing methods are being developed for biofuel production that employ different strategies for pretreatment, enzyme cocktails, and microorganisms. Many of these processes are focused on the production of ethanol, but butanol and other useful molecules (e.g., lactic acid, succinic acid, polyalkanoates, etc.) can also be produced in this type of process. The conversion product molecule produced is usually defined by the microorganisms selected for fermentation.

Thermochemical processes employ very high temperatures in a low oxygen (i.e., $O_2$) environment to completely degrade the organic constituents of biomass to syngas, largely composed of molecular hydrogen ($H_2$) and carbon monoxide (CO) gas. These simple molecules are then re-formed into more useful and valuable molecules (fuels or chemical intermediates) utilizing a Fischer-Tropsch process or other methods usually employing a chemical catalyst of some sort. These processes are effective at producing biofuels that are similar to current petrochemical-based hydrocarbon fuels (i.e., gasoline, diesel, jet fuel), although other biofuel molecules can also be produced in these types of processes (i.e., ethanol, butanol, kerosene).

A variant form of thermochemical process uses pyrolysis (i.e., thermal degradation in the complete absence of oxygen) to partially degrade the organic constituents present in plant biomass to a chemically heterogeneous liquid bio-oil. This serves to increase the energy density of the biomass to facilitate transport to centralized processing facilities where the bio-oil is further processed to a desired product slate.

The economic viability of biomass conversion processes is significantly impacted by the composition of the plant material and its conversion efficiency to heat, electricity, biofuels or chemical intermediates under specific processing conditions. For biochemical processes producing biofuels or other chemicals, the recalcitrance of the lignocellulose matrix of the biomass is a major factor in conversion efficiency.

SUMMARY

The present invention relates to methods of altering biomass composition in plants. Plants having altered biomass composition are useful for agriculture, forage, horticulture, biomass to energy conversion, paper production, plant product production, and other industries. For example, this document features dedicated energy crops such as *Panicum virgatum* L. (switchgrass), *Miscanthus* sp., e.g. *Miscanthus×gigantus* (miscanthus), *Sorghum* sp., *Saccharum* sp. (sugar cane), or *Arundo donax* having altered biomass composition.

Thus, in one aspect, this document features a *sorghum*, *Miscanthus*, *Panicum*, or sugarcane plant cell comprising an exogenous nucleic acid. The exogenous nucleic acid comprises a regulatory region operably linked to a nucleotide sequence encoding a polypeptide, wherein the HMM bit score of the amino acid sequence of the polypeptide is greater than about 65, based on the amino acid sequences depicted in one of FIG. 1, 2, 4, 6, 7, 8, or 9. Furthermore, a plant produced from the plant cell has a difference in biomass composition as compared to the corresponding composition of a control plant that does not comprise the nucleic acid. In another aspect, the exogenous nucleic acid in the *sorghum, Miscanthus, Panicum*, or sugarcane plant comprises a regulatory region operably linked to a nucleotide sequence encoding a polypeptide having 80 percent or greater sequence identity to an amino acid sequence selected from the group consisting of SEQ ID NO: 1, 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 99, 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 471, 473, 475, 476, 477, 478, 479, 480, 481, 482, 483, 484, 485, 487, 488, 489, 490, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 721, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, 1139, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, and 1567. A plant produced from such a plant cell has a difference in biomass composition as compared to the corresponding composition of a control plant that does not comprise the nucleic acid. The difference in biomass composition in the plant can be an increase in the total sugar content, an increase in sugar availability from the cell wall, increase in total glucose released from pretreatment, an increase in total sugar content in juice, increased juice brix, increase in yield of juice, increase in sucrose purity in juice, increase in sugar yield in juice from the plant, a decrease in ash content, and/or an increase in total glucan content. The difference in biomass composition in the plant can be at least a 1.5 fold, 2.0 fold, or 2.5 fold increase in glucose from cell well as compared to that of a control plant that does not comprise the nucleic acid. The difference in biomass composition in the plant can be at least a 3 fold, 4 fold, or 6 fold increase in sugar yield as compared to that of a control plant that does not comprise the nucleic acid. The difference in biomass composition in the plant can be an increase in conversion efficiency as compared to that of a control plant that does not comprise said nucleic acid. This document also features methods of producing such *sorghum*, switchgrass, sugarcane or *Miscanthus* plants. The plant or plant cell can also contain a second exogenous nucleic acid that comprises a regulatory region operably linked to a sequence of interest.

The polypeptide can comprise a 2OG-Fe(II) oxygenase superfamily domain having 60 percent or greater sequence identity to residues 211-309 of SEQ ID NO: 471 or to residues 209-306 of SEQ ID NO:1. In some embodiments, the polypeptide comprises an alpha/beta hydrolase fold domain having 60 percent or greater sequence identity to residues 116-329 of SEQ ID NO: 99 and a carboxylesterase family domain having 60 percent or greater sequence identity to residues 110-210 of SEQ ID NO: 99. Such polypeptides include GA 20-oxidases. The polypeptide can comprise a cytochrome P450 domain having 60 percent or greater sequence identity to residues 142-500 of SEQ ID NO:1429, to residues 176-504 of SEQ ID NO:1386, or to residues 98-368 of SEQ ID NO:1274.

In another aspect, this document features a plant cell comprising an exogenous nucleic acid. The exogenous nucleic acid encodes a transcription product that inhibits expression of a polypeptide having 80 percent or greater sequence identity to an amino acid sequence selected from the group consisting of SEQ ID NO: 188, 189, 190, 191, 193, 194, 195, 196, 197, 198, 199, 201, 202, 203, 204, 205, 206, 207, 208, 209, 211, 213, 215, 216, 217, 219, 220, 221, 222, 224, 225, 226, 228, 230, 231, 232, 233, 235, 236, 238, 239, 240, 241, 242, 243, 244, 245, 247, 248, 249, 250, 251, 252, 254, 255, 256, 257, 258, 259, 260, 261, 262, 264, 265, 266, 267, 268, 269, 270, 272, 273, 274, 275, 276, 277, 278, 279, 280, 282, 283, 284, 285, 286, 287, 288, 290, 291, 292, 293, 294, 295, 296, 297, 298, 299, 300, 301, 303, 305, 306, 308, 309, 310, 311, 313, 314, 315, 316, 317, 319, 320, 321, 322, 323, 324, 325, 326, 328, 329, 330, 332, 333, 334, 335, 336, 337, 338, 339, 340, 341, 342, 344, 346, 347, 348, 349, 350, 351, 352, 353, 354, 355, 356, 357, 358, 360, 361, 362, 363, 364, 365, 367, 368, 370, 371, 373, 374, 375, 376, 377, 378, 379, 380, 382, 383, 384, 386, 387, 388, 389, 391, 392, 393, 394, 395, 396, 397, 398, 399, 400, 402, 403, 404, 405, 406, 407, 408, 409, 410, 412, 413, 414, 415, 417, 418, 419, 420, 421, 422, 423, 424, 425, 427, 428, 429, 430, 432, 433, 434, 435, 436, 437, 438, 440, 441, 443, 444, 445, 446, 447, 449, 451, 452, 453, 454, 456, 457, 458, 459, 460, 462, 463, 464, 465, 466, 467, 468, 469, 470, 1009, 1010, 1011, 1012, 1013, 1014, 1015, 1016, 1017, 1018, 1019, 1020, 1021, 1022, 1023, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, and 1273.

This document also features a plant cell that include an exogenous nucleic acid encoding a transcription product that inhibits expression of a polypeptide, wherein the HMM bit score of the amino acid sequence of the polypeptide is greater than about 65, the HMM based on the amino acid sequences depicted in one of FIGS. 1, 2, 4, 6, 7, 8, and 9.

A plant produced from the plant cell has a difference in biomass composition as compared to the corresponding composition of a control plant that does not comprise the nucleic acid. The transcription product can be an interfering RNA. The difference in biomass composition in the plant can be an increase in the total sugar content, an increase in sugar availability from the cell wall, increase in total glucose released from pretreatment, an increase in total sugar content in juice, increased juice brix, increase in yield of juice, increase in sucrose purity in juice, and/or increase in sugar yield in juice from the plant. The difference in biomass composition in the plant also can be selected from the group consisting of a decrease in ash content and an increase in the total glucan content.

This document features a method of producing biomass. Such a method comprises growing a plurality of the transgenic plants described herein; and harvesting biomass from the plants. The plurality of plants can be *sorghum* plants and the harvesting step can comprise harvesting stalks from the plants. The method can further comprise pretreating the harvested biomass. The method can further comprise the step of enzymatically processing the harvested biomass.

This document also features a method of processing biomass. Such a method comprises extracting sugars from biomass from a plurality of transgenic plants described herein. The method can further include the step of crystallizing the sugars (e.g., sucrose).

This document also features a method of altering biomass composition in *sorghum, Miscanthus, Panicum*, or sugarcane. Such a method comprises modifying an endogenous biomass composition-modulating nucleic acid in a *sorghum, Miscanthus, Panicum*, or sugarcane plant. The nucleic acid comprises a nucleotide sequence with an open reading frame having 80 percent or greater sequence identity to the nucleotide sequence selected from the group consisting of SEQ ID NO: 5, 7, 34, 43, 68, 73, 78, 80, 93, 100, 102, 109, 118, 122, 125, 130, 147, 149, 153, 165, 168, 174, 178, 192, 200, 210, 212, 214, 218, 223, 227, 229, 234, 237, 246, 253, 263, 271, 281, 289, 302, 304, 307, 312, 318, 327, 331, 343, 345, 359, 366, 369, 372, 381, 385, 390, 401, 411, 416, 426, 431, 439, 442, 448, 450, 455, 461, 472, 474, 486, 494, 497, 507, 516, 543, 557, 560, 565, 581, 591, 596, 598, 603, 611, 616, 642, 662, 687, 694, 704, 722, 753, 755, 766, 771, 774, 786, 798, 811, 819, 840, 848, 903, 977, 979, 1030, 1039, 1043, 1054, 1065, 1075, 1078, 1081, 1088, 1090, 1098, 1103, 1107, 1109, 1112, 1118, 1132, 1134, 1137, 1153, 1178, 1190, 1201, 1203, 1207, 1212, 1246, 1253, and 1265.

This document also features methods of altering biomass composition in *Miscanthus* that comprise inhibiting an endogenous biomass composition-modulating nucleic acid in a *Miscanthus* plant. In such methods, an RNAi sequence may comprise a sequence having 80 percent or greater sequence identity to the nucleotide sequence selected from the group consisting of SEQ ID NO: 1568, 1569, 1570, 1571, 1572, 1573, 1574, 1575, 1576, 1577, 1578, 1579, and 1580, or a fragment thereof.

The plant has a difference in biomass composition as compared to the corresponding composition of a control plant in which the nucleic acid has not been modified. The difference in biomass composition in the plant can be an increase in total sugar content, an increase in sucrose content, a decrease in ash content or an increase in total glucan content. The modification can be effected by introducing a genetic modification in the locus comprising the nucleic acid. The method can further include selecting for plants having altered biomass composition.

This document also features a *sorghum, Miscanthus, Panicum*, or sugarcane plant cell containing a modified endogenous nucleic acid encoding a polypeptide. The HMM bit score of the amino acid sequence of the polypeptide is greater than about 65, with the HMM based on the amino acid sequences depicted in one of FIGS. 1-9. A plant produced from the plant cell has a difference in biomass composition as compared to the corresponding composition of a control plant where the nucleic acid has not been modified. The difference in biomass composition in the plant can be an increase in total sugar content, an increase in sucrose content, a decrease in ash content or an increase in total glucan content. This document also features a method of producing such sorghum, Miscanthus, Panicum, or sugarcane plants.

This document also features a sorghum, Miscanthus, Panicum, or sugarcane plant cell containing a modified biomass composition-modulating endogenous nucleic acid. The endogenous nucleic acid comprises a nucleotide sequence with an open reading frame having 80 percent or greater sequence identity to the nucleotide sequence selected from the group consisting of SEQ ID NO: 5, 7, 34, 43, 68, 73, 78, 80, 93, 100, 102, 109, 118, 122, 125, 130, 147, 149, 153, 165, 168, 174, 178, 192, 200, 210, 212, 214, 218, 223, 227, 229, 234, 237, 246, 253, 263, 271, 281, 289, 302, 304, 307, 312, 318, 327, 331, 343, 345, 359, 366, 369, 372, 381, 385, 390, 401, 411, 416, 426, 431, 439, 442, 448, 450, 455, 461, 472, 474, 486, 494, 497, 507, 516, 543, 557, 560, 565, 581, 591, 596, 598, 603, 611, 616, 642, 662, 687, 694, 704, 722, 753, 755, 766, 771, 774, 786, 798, 811, 819, 840, 848, 903, 977, 979, 1030, 1039, 1043, 1054, 1065, 1075, 1078, 1081, 1088, 1090, 1098, 1103, 1107, 1109, 1112, 1118, 1132, 1134, 1137, 1153, 1178, 1190, 1201, 1203, 1207, 1212, 1246, 1253, and 1265.

This document also features a Miscanthus plant cell containing a modified biomass composition-modulating endogenous nucleic acid. In such methods, an RNAi sequence may comprise a sequence having 80 percent or greater sequence identity to the nucleotide sequence selected from the group consisting of SEQ ID NO: 1568, 1569, 1570, 1571, 1572, 1573, 1574, 1575, 1576, 1577, 1578, 1579, and 1580, or a fragment thereof.

A plant produced from such a sorghum, Miscanthus, Panicum, or sugarcane plant cell has a difference in biomass composition as compared to the corresponding composition of a control plant where the nucleic acid has not been modified. The difference in biomass composition in the plant can be an increase in total sugar content, an increase in sucrose content, a decrease in ash content or an increase in total glucan content.

In another aspect, this document features a method of modulating biomass composition of a plant. Such a method comprises introducing into a sorghum, Miscanthus, Panicum, or sugarcane plant an exogenous nucleic acid. The exogenous nucleic acid encodes or affects a polypeptide in the gibberellin (GA) biosynthesis or signaling pathway so as to increase levels of, or sensitivity to, active gibberellins. The plant has a difference in biomass composition as compared to the corresponding composition of a control plant that does not comprise the exogenous nucleic acid. The difference in biomass composition in the plant can be an increase in total sugar content, an increase in sucrose content, a decrease in ash content or an increase in total glucan content.

In another aspect, this document features a method of modulating biomass composition of a plant. Such a method comprises introducing into a plant first and second exogenous nucleic acids. The first exogenous nucleic acid encodes or affects a polypeptide in the GA biosynthesis or signaling pathway so as to increase levels of, or sensitivity to, active gibberellins and the second exogenous nucleic acid encodes a sequence of interest. The plant has a difference in biomass composition as compared to the corresponding composition of a control plant that does not comprise the exogenous nucleic acids. The difference in biomass composition in the plant can be an increase in total sugar content, an increase in sucrose content, a decrease in ash content or an increase in total glucan content.

This document also features a sorghum, Miscanthus, Panicum, or sugarcane plant cell or plant comprising an exogenous nucleic acid. The exogenous nucleic acid encodes or affects a polypeptide in the GA biosynthesis or signaling pathway so as to increase levels of, or sensitivity to, active gibberellins. The plant has a difference in biomass composition as compared to the corresponding level of a control plant that does not comprise the exogenous nucleic acid. The difference in biomass composition in the plant can be an increase in total sugar content, an increase in sucrose content, a decrease in ash content or an increase in total glucan content.

This document also features a sorghum plant containing an exogenous biomass composition-modulating nucleic acid. The plant has an increase in total sugar content in juice, increase in juice brix, and/or increase in yield of sugar from juice from the plant that is statistically significantly greater than that of a corresponding control plant that lacks the biomass composition-modulating nucleic acid. The plant can have a sucrose content that is statistically significantly greater than the sucrose content of a corresponding control plant that lacks the biomass composition-modulating nucleic acid.

This document also features a sorghum, Panicum, Miscanthus, or sugarcane plant containing an exogenous biomass composition-modulating nucleic acid. The plant has a biomass composition that is statistically significantly different from the biomass composition of a corresponding control plant that lacks the biomass composition-modulating nucleic acid. Biomass from the plant can have an increase in the total sugar content, an increase in sugar availability from the cell wall, increase in total glucose released from pretreatment, an increase in total sugar content in juice, increase in juice brix, increase in yield of juice, increase in sucrose purity in juice, and/or increase in sugar yield in juice from the plant relative to a corresponding control plant that lacks the biomass composition-modulating nucleic acid.

In another aspect, this document features a method of producing biomass, comprising applying a gibberellin (e.g., GA3) to a population of plants (e.g., sorghum, Panicum, Miscanthus, sugarcane, or Arundo donax), and harvesting cellulosic biomass from the plants.

This document also features a method of processing biomass. The method includes pretreating biomass harvested from a plurality of plants (e.g., sorghum, switchgrass, Miscanthus, sugarcane, or Arundo donax plants) to which a gibberellin has been applied; and extracting sugars from the pretreated biomass. The pretreating step can include a physical or chemical pretreatment of biomass harvested from plants to which a gibberellin has been applied a plurality of times. The method further can include the step of saccharifying the pretreated biomass before extracting cell wall-associated sugars. The total amount of sugar extracted from the biomass can be statistically significantly increased compared to that of biomass from corresponding control plants to which a gibberellin has not been applied.

In another aspect, this document features a method of processing biomass, comprising pretreating biomass harvested from a plurality of plants to which a gibberellin has been applied, fermenting the biomass and producing a fuel from the fermented biomass. The pretreating step can be a physical or chemical treatment of the harvested biomass. The method can further comprise the step of saccharifying the pretreated biomass before fermenting. The saccharifying step can comprise saccharifying biomass harvested from plants to which a gibberellin has been applied a plurality of times. The pretreating step releases a significant increase in cell wall associated sugars compared to pretreating biomass from corresponding control plants to which a gibberellin has not been applied. The biomass can have an increased yield of fuel compared to biomass from corresponding control plants to which a gibberellin has not been applied. The plants can be transgenic switchgrass, *sorghum*, sugarcane, or *Miscanthus* plants as described herein. The plants can be sugarcane plants. The gibberellin can be GA3.

In another aspect, this document features a method of processing biomass, comprising pyrolysing biomass harvested from a plurality of plants to which a gibberellin has been applied and producing a fuel from the pyrolysed biomass.

This document also features a method of processing biomass, comprising gasifying biomass harvested from a plurality of plants to which a gibberellin has been applied, and producing a fuel from the gasified biomass. The biomass can have a decreased ash content compared to biomass from corresponding control plants to which a gibberellin has not been applied.

This document also features a method of processing biomass, comprising pyrolysing biomass harvested from a plurality of transgenic plants described herein, and producing a fuel from the pyrolysed biomass.

This document also features a method of processing biomass, comprising gasifying biomass harvested from a plurality of transgenic plants described herein, and producing a fuel from the gasified biomass. The biomass can have a decreased ash content compared to biomass from corresponding control plants that lack the exogenous nucleic acid. The biomass can be harvested from plants to which a gibberellin has been applied.

This document also features a method of producing a forage product that includes growing a plurality of the plants described herein; harvesting biomass from the plants; chopping or cutting the harvested biomass; and ensiling the chopped or cut biomass to produce the forage product.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

DESCRIPTION OF DRAWINGS

Figure 1A:
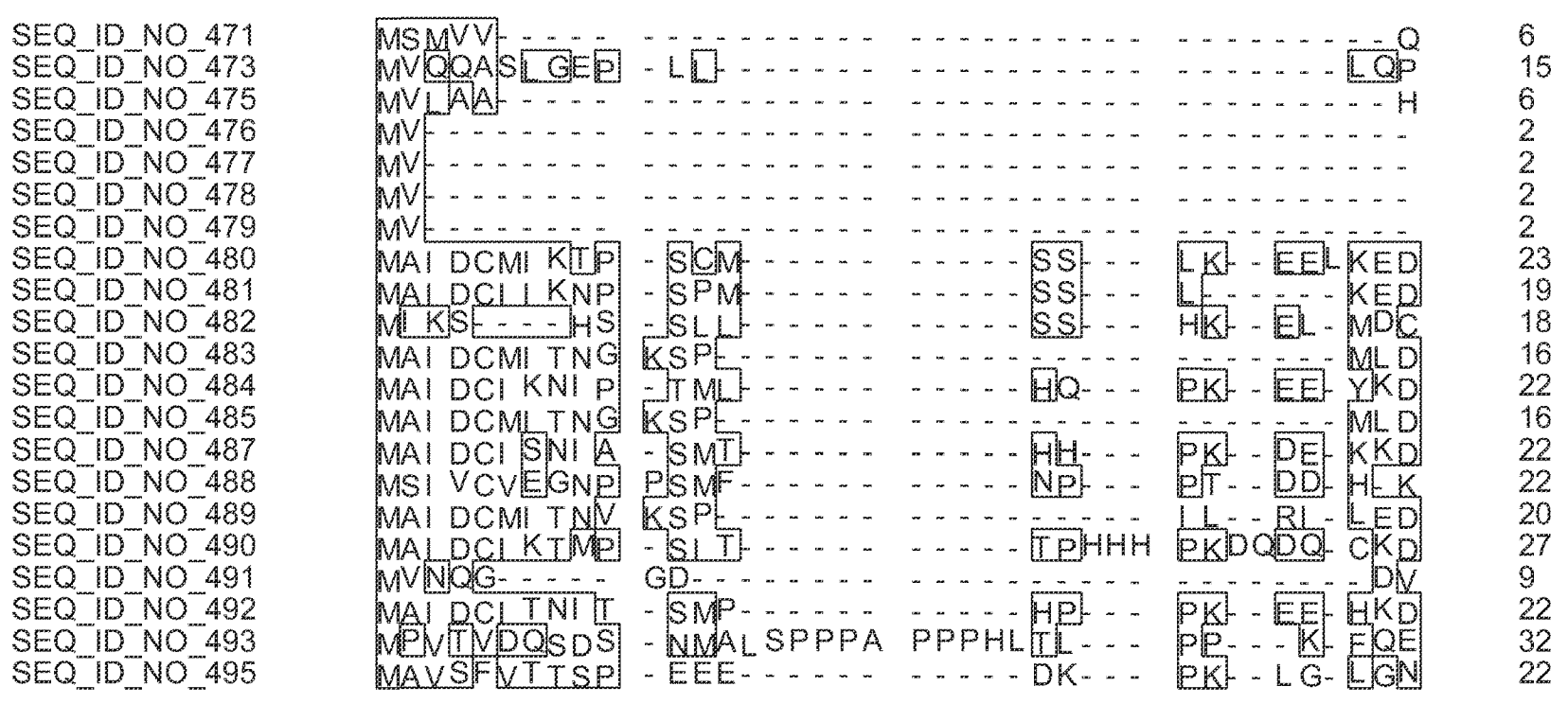
Figure 1E:
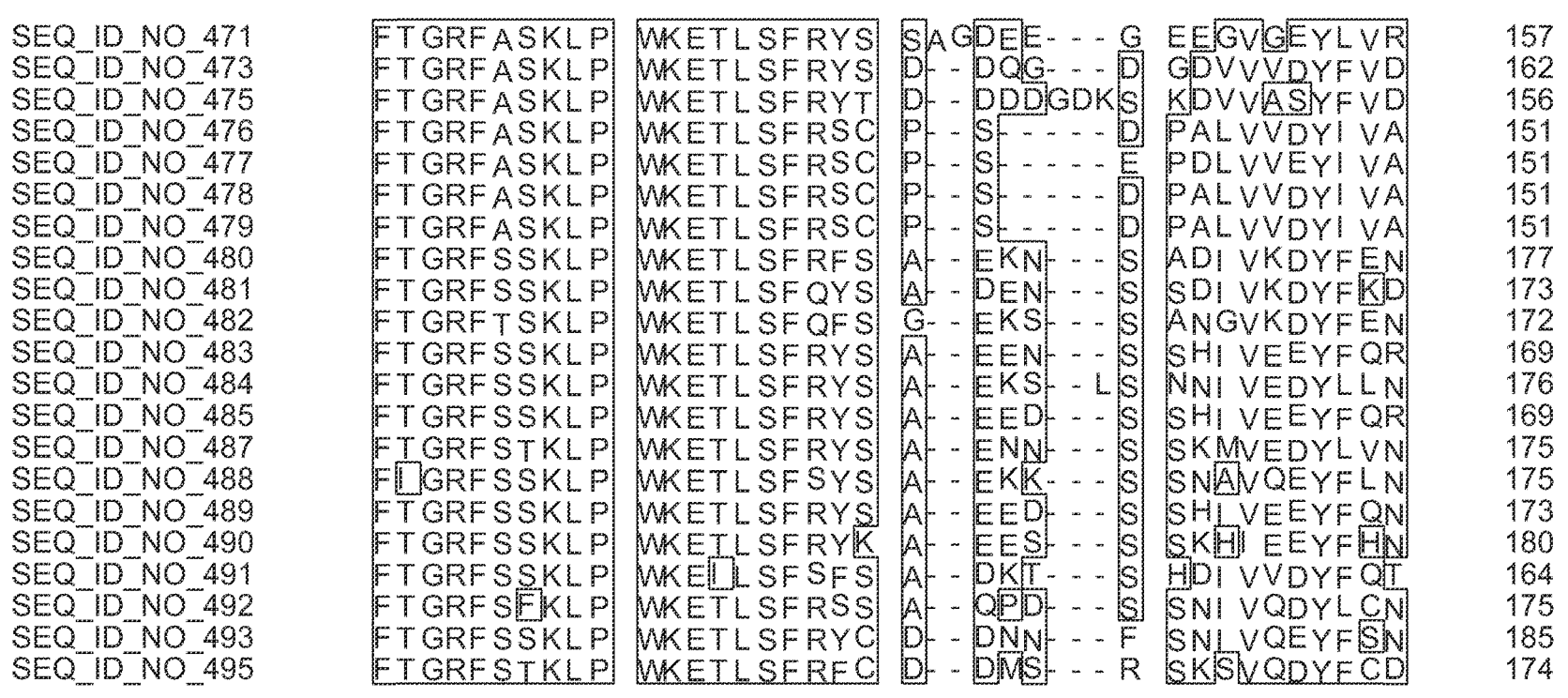
Figure 1F:
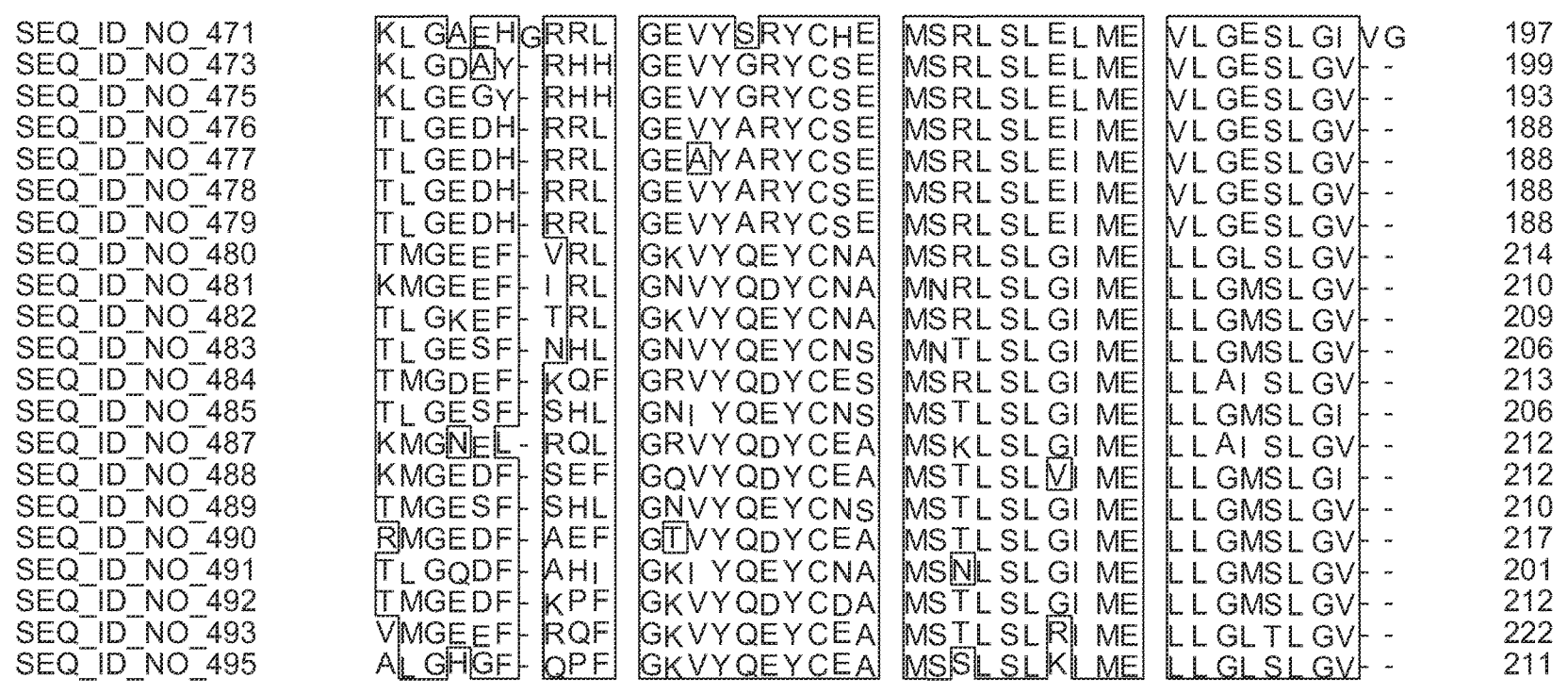

FIGS. 1A-1K contain an alignment of the amino acid sequence of GI_115456701 (SEQ ID NO: 471) with homologous and/or orthologous amino acid sequences. In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIGS. 2A-2E contain an alignment of the amino acid sequence of GI_75324272 (SEQ ID NO: 99) with homologous and/or orthologous amino acid sequences.

FIGS. 3A-3I contain an alignment of the amino acid sequence of GI_75139772 (SEQ ID NO: 188) with homologous and/or orthologous amino acid sequences.

FIGS. 4A-4L contain an alignment of the amino acid sequence of GI_85540948 (SEQ ID NO:1) with homologous and/or orthologous amino acid sequences.

FIGS. 5A-5J contain an alignment of the amino acid sequence of G2OX1_ARATH (SEQ ID NO: 287) with homologous and/or orthologous amino acid sequences.

FIGS. 6A-6H contain an alignment of the amino acid sequence of Cytochrome P450 CYP68B1 GiGA20-oxidase (SEQ ID NO: 1429) with homologous and/or orthologous amino acid sequences.

FIGS. 7A-7B contain an alignment of the amino acid sequence of GA4 desaturase (SEQ ID NO: 1542) with homologous and/or orthologous amino acid sequences.

FIGS. 8A-8B contain an alignment of the amino acid sequence of Cytochrome P450 GA14-synthase (SEQ ID NO: 1386) with homologous and/or orthologous amino acid sequences.

FIGS. 9A-9D contain an alignment of the amino acid sequence of Cytochrome P450 CYP69A1 C13-oxidase (SEQ ID NO: 1274) with homologous and/or orthologous amino acid sequences.

DETAILED DESCRIPTION

Figure 1K:
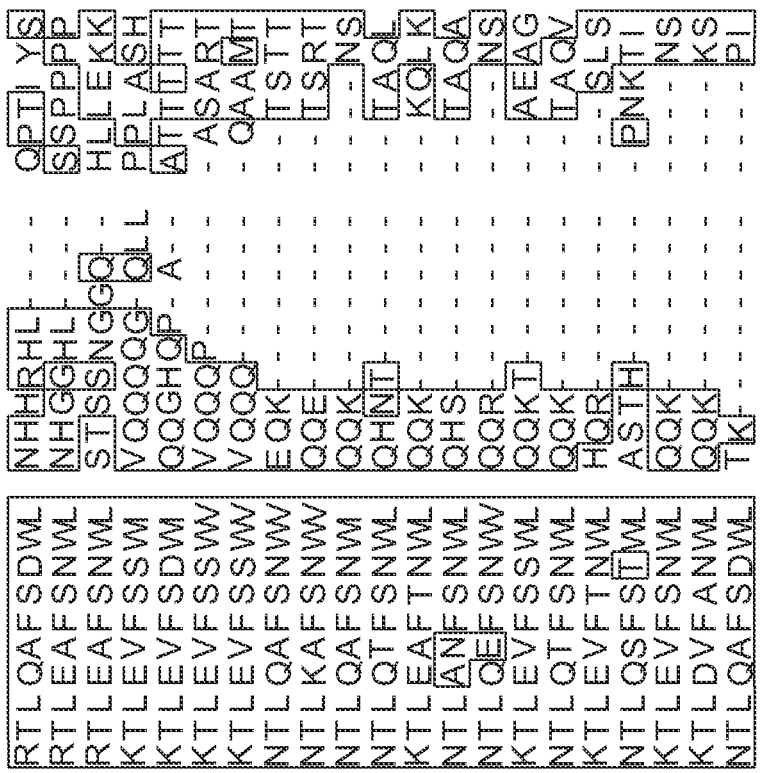

This document features methods and materials related to modulating biomass composition (e.g., one or more of total sugar content, sucrose content, ash content and total glucan content, an increase in sugar availability from the cell wall, increase in total glucose released from pretreatment, an increase in total sugar content in juice, increase in juice brix, increase in yield of juice, increase in sucrose purity in juice, increase in sugar yield in juice from the plant, or increase in conversion efficiency) in plants. For example, this document features methods and materials for increasing or decreasing total sugar content, ash content and/or total glucan content in plants. In some embodiments, a plant can have one or more of increased total sugar content, increased sucrose content, an increase in sugar availability from the cell wall, increase in total glucose released from pretreatment, an increase in total sugar content in juice, increase in juice brix, increase in yield of juice, increase in sucrose purity in juice, increase in sugar yield in juice from the plant, increased conversion efficiency, decreased ash content, and increased total glucan content. In some embodiments, the plants also may have modulated levels of, for example, lignin, modified root architecture, modified herbicide resistance, or modified carotenoid biosynthesis. The methods can include, for example, (i) transforming a plant cell with a nucleic acid encoding a biomass composition-modulating polypeptide, wherein expression of the polypeptide results in modulated biomass composition or (ii) transforming a plant cell with a nucleic acid encoding a transcription product that inhibits expression of a biomass composition-modulating polypeptide, wherein decreased expression of the polypeptide results in modulated biomass composition. Plant cells produced using such methods can be grown to produce plants having an increased or decreased sugar content and/or conversion efficiency. Such plants may produce more grazable forage. Increased brix levels and/or sugar content can result in increased palatability as a forage crop. Biomass harvested from such plants can be cut or chopped and ensiled, with or without additives, to produce a forage product. In addition, such plants, and the seeds of such plants, may be used to produce, for example, switchgrass, miscanthus, *Sorghum* sp., and sugar cane plants having increased value as a biofuel feedstock.

I. DEFINITIONS

"Accessible Carbohydrate" refers to mono- and oligo-saccharides released into the aqueous phase after processing of a biomass feedstock. The amount of accessible carbohydrate in a feedstock is related to the pretreatment and enzymatic saccharification conditions chosen for the saccharification process and to the composition and structure of the initial biomass feedstock.

"Amino acid" refers to one of the twenty biologically occurring amino acids and to synthetic amino acids, including D/L optical isomers.

"Ash" refers to inorganic material that contributes to the dry weight of the feedstock. Ash content in biomass feedstocks can be determined using published, standard methods such as ASTM Standard E1755.

"Biochemical processing" refers to a primarily biological process where plant materials are converted to liquid products using enzymes and/or fermentation organisms. Biochemical processing may require thermochemical pretreatments.

"Biofuels" include, but are not limited to, biodiesel, methanol, ethanol, butanol, linear alkanes ($C_5$-$C_{20}$), branched-chain alkanes ($C_5$-$C_{26}$), mixed alkanes, linear alcohols ($C_1$-$C_{20}$), branched-chain alcohols ($C_1$-$C_{26}$), linear carboxylic acids ($C_2$-$C_{20}$), and branched-chain carboxylic acids ($C_2$-$C_{26}$). In addition, ethers, esters and amides of the aforementioned acids and alcohols, as well as other conjugates of these chemicals may be of interest. Many of these chemicals can be subsequently converted by chemical reactions to other high value, high volume chemicals.

"Biomass" refers to organic matter. Biomass includes plant matter derived from herbaceous and woody energy crops, agricultural food and feed crops, agricultural crop wastes and residues, wood wastes and residues, aquatic plants, and other plant-derived materials. Biomass may also include algae, yard wastes, and include some municipal wastes. Biomass is a heterogeneous and chemically complex renewable resource. Components of biomass include glucan, xylan, fermentable sugars, arabinan, sucrose, lignin, protein, ash, extractives, ferulate, and acetate.

In some embodiments, biomass primarily encompasses above ground plant parts. In some embodiments, biomass primarily encompasses stem plant parts. In some embodiments, biomass primarily encompasses those above ground plant parts other than inflorescence and seed parts of a plant. Biomass can be quantified as dry matter yield, which is the mass of biomass produced (usually reported in Tons/acre) if the contribution of water is subtracted from the fresh mater weight. Dry matter yield (DMY) yield is calculated using the fresh matter weight (FMW) and a measurement of weight percent moisture (M) in the following equation: DMY=(100−M)/100)*FMW. Biomass can be quantified as fresh matter yield, which is the mass of biomass produced (usually reported in Tons/acre) on an as-received basis, which includes the weight of moisture. Biomass can sometimes be quantified as juice yield, e.g., the volume of juice separated from bagasse or *sorghum* or sugarcane stalks, which can be reported per unit area.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Conversion efficiency" refers to the percentage of biomass feedstock converted to product relative to one or more inputs. The product can be energy, automotive fuel, jet fuel, free sugars, fermentable sugars, syngas, ethanol, heat, electricity, or energy, and the input can a parameter such as the amount of biomass, total carbohydrate, amount and type of saccharification enzyme(s), or accessible carbohydrate. The concept of conversion efficiency describes the yield of energy (in terms of biofuel, heat, and/or electricity) derived from a biomass starting material subjected to a particular process as compared to a theoretical yield of energy stored in the biomass starting material. The efficiency by which biomass can be converted into energy via these processes is dependent upon a number of compositional characteristics of the biomass. The relevant compositional characteristics differ based on the conversion process design.

Generally, the conversion efficiency of biochemical processes is most influenced by the concentration of carbohydrate in the biomass and the ease with which that carbohydrate can be hydrolyzed to fermentable sugars. In biochemical processing the lignin in the feedstock is typically converted to energy by burning to generate heat and electricity. Similarly, the efficiency and yield of thermochemical processes for the production of biofuels are most influenced by the overall amounts of carbon to hydrogen to oxygen (C:H:O weight percents) and ash content of the biomass. The efficiency of thermochemical combustion processes is most influenced by the higher heating value (HHV) and ash content of the biomass. The HHV of biomass is a function of carbon, hydrogen and oxygen content of the biomass. The relevant conversion efficiency parameters are dependent on the type of conversion process employed (biochemical, thermochemical to biofuel, or thermochemical to heat and electricity).

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Glucan," "Xylan" and "Arabinan" refer to the anhydro forms of glucose, xylose and arabinose that are found in cellulose and hemicellulose carbohydrate polymers. Thus, for example, "glucan" refers to a polysaccharide of D-glucose monomers linked by glycosidic bonds. The following are glucans: cellulose ($\beta$-1,4-glucan), dextran ($\alpha$-1,6-glucan) and starch ($\alpha$-1,4- and $\alpha$-1,6-glucan). See, Technical Report NREL/TP-510-42618, Determination of Structural Carbohydrates and Lignin in Biomass.

"Hemicellulose" is a general term used to refer to cell wall polysaccharides that are not celluloses or pectins. Hemicelluloses contain repeating monomeric units of a five-carbon sugar (usually D-xylose or L-arabinose) and/or a six-carbon sugar (D-galactose, D-glucose, and D-mannose). See, U.S. Pat. No. 7,112,429. Hemicelluloses typically are shorter in length than cellulose and are highly branched. Xylan is often the structural backbone of hemicelluloses from hardwoods and grasses, and hydrolysis of these biomass types releases products high in the five-carbon sugar, xylose. Hemicelluloses from softwoods are most commonly gluco-galacto-mannans, which have a mannan backbone and yield mannose as the main product of hydrolysis. Hemicelluloses often contain side groups such as acetyl groups, uronic acids and ferulates.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Higher heating value" (HHV) refers to the amount of heat released by a specified quantity of a fuel at an initial temperature of 25° C., following combustion, and return of the combustion products to a temperature of 25° C. The HHV is also known as the gross calorific value or gross energy.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Lignin" refers to a polyphenolic polymeric substance of plant cells, with a complex, cross-linked, highly aromatic structure. Lignin is synthesized in plants principally from three monolignol monomers, which can be methoxylated to various degrees: sinapyl alcohol ($C_{11}H_{14}O_4$) that is incorporated into lignin as (S) syringyl units; coniferyl alcohol ($C_{10}H_{12}O_3$) that is incorporated into lignin as (G) guaiacyl units; and p-coumaryl alcohol ($C_9H_{10}O_2$) that is incorporated into lignin as (H) p-hydroxyphenyl units. These monomers can be synthesized into lignin by extensive condensation polymerization. The lignin present in different plant varieties can have different syringyl:guaiacyl:p-hydroxyphenyl weight percents (S:G:H weight percents). For example, certain grass varieties can have lignin composed almost entirely of guaiacyl (G). Lignin is a major structural constituent of plant cells in woody species.

"Modulation" of the level of biomass refers to the change in the level of the biomass that is observed as a result of expression of, or transcription from, an exogenous nucleic acid in a plant cell and/or plant. The change in level is measured relative to the corresponding level in control plants.

"NOX emissions" refers to mono-nitrogen oxides (NOx), such as NO and NO2, released into the atmosphere. While oxygen and nitrogen gases do not typically react at ambient temperatures, oxygen and nitrogen gases can react at higher temperatures to create various oxides of nitrogen, including mono-nitrogen oxides. Mono-nitrogen oxides can also be produced by combusting materials including elemental nitrogen. Mono-nitrogen oxides (NOx) released into the atmosphere can react with volatile organic compounds to produce smog. Accordingly, NOX emissions may be regulated by various governmental agencies. Oxides of sulfur (SOx), specifically sulfur dioxide, are often generated in the same processes. SOx emissions are known to contribute to acid rain.

"Nucleic acid" and "polynucleotide" are used interchangeably herein, and refer to both RNA and DNA, including cDNA, genomic DNA, synthetic DNA, and DNA or RNA containing nucleic acid analogs. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Recalcitrant carbohydrate material" refers to mono- and oligo-saccharides that are not released into the aqueous phase after processing of a biomass feedstock. It is related to the pretreatment and enzymatic saccharification conditions chosen for the saccharification process.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989).

"Saccharification" refers to the hydrolysis of carbohydrate material to the mono- and disaccharides that constitute the polymer. For example, saccharification of xylan results in the production of xylose, the monosaccharide constituent of xylan. Saccharification occurs during the biochemical processing of biomass in biorefineries, ultimately leading to the production of biofuels such as ethanol.

"Saccharification efficiency" of a feedstock sample refers to the total amount of mono and disaccharides solubilized by a pretreatment/enzymatic saccharification process, divided by the theoretical maximum amount of mono and disaccharides in the biomass sample that could have been released based on compositional analysis, converted to a percentage by multiplying by 100.

"Sustainability indicators" refer to components of biomass processing byproducts, such as the expected ash composition and soil nutrients, which may be recycled.

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. METHODS

This document features methods and materials related to modulating biomass composition. These methods and materials are based on the surprising discovery that biomass from plants overexpressing polypeptides in the GA pathway that increase levels of active gibberellins such as GA 20-oxidases can exhibit an altered compositional profile, such that biomass from such plants provides improved efficiency and/or has increased yield when used for biofuel or energy production. For example, transgenic plants overexpressing an exogenous nucleic acid encoding a GA 20-oxidase can exhibit an increased yield of glucose after pretreatment and enzymatic saccharification, and/or equivalent yields of glucose at lower amounts of saccharification enzymes relative to the enzyme amounts required for corresponding plants that do not overexpress the nucleic acid. Such plants can also exhibit modulation in the ash content and/or total glucan content.

Thus, this document features methods of producing biomass that involve growing a plurality of plants that overexpress a transgene encoding a polypeptide in the GA pathway that increase levels of active gibberellins such as GA 20-oxidase, GA 3-oxidase, GA 2-oxidase or a GA receptor, and harvesting biomass from such plants. Alternatively, such methods can comprise growing a plurality of plants that express an exogenous nucleic acid that downregulates genes such as DELLA. Suitable exogenous nucleic acids are described in more detail below, as well as techniques for increasing expression of endogenous genes. Suitable plants include *sorghum* plants, *Miscanthus* plants and switchgrass plants, as described in more detail below.

In some embodiments, methods for processing biomass from plants described herein include subjecting the biomass to a pretreatment and/or subjecting the biomass to enzymatic processing. Such methods are particularly suitable when biomass is to be fermented for biofuel production or to be used for energy production.

Typically, enzymatic processing conditions are defined by the type of enzymes used and the amount of each enzyme(s) used during the saccharification process in a biorefinery. For example, an enzymatic processing condition can entail the use of a single enzyme preparation such as Spezyme® CP (Genencor, USA) or Celluclast 1.5 L (Novozymes, Franklinton, N.C.). Spezyme® CP and Celluclast 1.5 L are commercially available enzyme mixtures containing cellulases that are prepared by submerged culture fermentation of the filamentous fungus, *Trichoderma reesei*. These cellulase preparations are deficient in β-glucosidase activity, so they are often supplemented with a β-glucosidase preparation such as Novozyme 188, obtained by submerged culture fermentation of *Aspergillus niger*. Novozyme 188 is available from Sigma (St. Louis, Mo., USA) as catalog number C6105.

Enzyme cocktails containing a plurality of enzymes are sometimes used in biomass processing, such cocktails differing from each other in the type and amount of each enzyme. In some embodiments, an enzymatic processing condition includes the use of two types or three types of enzyme, e.g., Spezyme® CP in combination with a xylanase, or an endo-β-(1,4)-glucanase (EC 3.2.1.4), an exo-β-(1,4)-glucanase (EC 3.2.1.91) and a β-D-glucosidase (EC 3.2.1.21). See, e.g., U.S. Pat. Nos. 5,874,274; 6,333,181; 7,059,993 and U.S. Patent Publication 2007/0092935. Other enzymes include β-1,4-cellobiohydrolases (CBH I & CBH II); xylanases (XYN I & XYN II); β-glucosidase; α-L-arabinofuranosidase; acetyl xylan esterase; β-mannanase; and α-glucuronidase.

Biomass processing sometimes includes a physical or chemical pretreatment before enzymatic processing. A typical pretreatment is a dilute-acid thermochemical pretreatment, which partially or completely hydrolyzes the hemicellulose and can also hydrolyze some of the lignin. See, e.g., U.S. Pat. No. 6,090,595. Other types of pretreatment include sulfite pretreatment and ozone pretreatment. Thus, in some embodiments, a method described herein involves pretreating biomass prior to enzymatic processing.

Biomass processing can also include a fermentation step, which typically results in the production of fuels such as ethanol. In some cases, the enzymatic saccharification and fermentation steps are carried out simultaneously. If enzymatic saccharification and fermentation are carried out sequentially, the product of the saccharification step can be separated into an aqueous mixture containing mono- and disaccharides, and residual materials, primarily lignin. The aqueous mixture is then subjected to fermentation. Suitable organisms for use in fermentation include *Saccharomyces* spp., *Zymomonas mobilis* and *Clostridium* spp.

In other embodiments, biomass from plants described herein can be processed by thermochemical techniques to produce fuels, energy or heat. Accordingly, a method of processing biomass can involve subjecting biomass from plants described herein to heat and/or pressure under reduced oxygen conditions, which results in the formation of syngas (primarily carbon monoxide and hydrogen). The gasification step typically uses temperatures from about 800° C. to 1400° C. The syngas is then conditioned to remove particulates, light hydrocarbons such as methane, and tar. The syngas can then be used to produce fuels such as gasoline, diesel or methanol. Alternatively, a method of processing biomass can involve subjecting biomass from plants described herein to pyrolysis, i.e., heat and/or pressure in the absence of oxygen. The pyrolysis step typically uses temperatures from about 400° C. to 800° C., and results in the formation of biomass tars. The resulting tars can be then used to produce products such as olefins, oils and specialty chemicals. Saccharification can be determined and saccharification efficiency can be calculated for individual monosaccharides, e.g., glucose conversion efficiency, for combinations of monosaccharides, e.g., glucose+xylose conversion efficiency, or for all monosaccharides. The choice of mono and disaccharide(s) for which saccharification efficiency is calculated in a method is based on factors such as the type of biomass to be processed, and the capability of the conversion process to use all or just some of the sugars made available for biofuel or energy production.

In some embodiments, sugars are extracted from plants described herein for use as a food. Alternatively, sugars can be extracted from plants described herein and further processed for other industrial uses. In these cases, a method can involve the steps of extracting sugars (mono- and disaccharides) from harvested biomass and, optionally, crystallizing the extracted sugars. For example, the stalks of *sorghum* plants described herein can be harvested by hand or mechanical harvesters, and the juice, containing mono- and disaccharides, extracted by crushing and pressing the stalks with a horizontal or vertical mill. Mono- and disaccharide solids can be produced by crystallization from the juice, which typically involves techniques such as filtering, clarifying, decolorizing, and repeated concentration.

Methods of producing biomass and methods of processing biomass disclosed herein can also involve the use of a gibberellin to facilitate modulation of biomass composition. Gibberellins are tetracyclic diterpene acids that function as plant hormones in dormancy and other aspects of germination. Gibberellins are named GA1 . . . GAn in the order of their discovery. One of the most potent is gibberellic acid, also called GA3. Other active GAs include GA4 and GA7. Thus, a method of producing biomass can comprise applying a gibberellin to a population of plants, either transgenic plants described herein or non-transgenic *sorghum*, switchgrass, sugarcane or *Miscanthus* plants. The gibberellin typically is applied to foliage in the mid- to late stages of a growing season by spraying, either with a mechanical sprayer or by airplane. A single treatment of a gibberellin can be applied, but more typically, multiple applications are made during a growing season, e.g., 2, 3, 4, 5 or 6 applications. Biomass is then harvested from such plants, which has a composition that differs from that of corresponding control plants to which a gibberellin has not been applied, e.g., such biomass has an increase in total sugar content, a decrease in ash content and/or an increase in total glucan content. Biomass from gibberellin-treated plants can be processed for fuel or energy production, e.g., can be subjected to a pretreatment, and/or enzymatic processing, and/or fermentation, to produce a biofuel. In some embodiments, biomass from gibberellin-treated plants such as *sorghum* or sugarcane is subjected to an extraction process to obtain sugars. In some embodiments, the resulting juice is purified to obtain sucrose, e.g., crystallized sucrose.

In some aspects the invention relates to methods for breeding plants with composition characteristics that make them more valuable as dedicated food, fuel or energy feedstocks. The $F_1$ or later generation progeny are selected for those plants having desirable attributes related to biomass composition and/or conversion efficiency. Conversion efficiency may be in terms of saccharification efficiency, the conversion of biomass feedstock to free sugars, fermentable sugars, syngas, or a biofuel. The relevant conversion efficiency parameter(s) are dependent on the type of conversion process employed (biochemical, thermochemical to biofuel, or thermochemical to biopower, heat and electricity). Thus, for example, a method of breeding a plant variety comprises crossing two or more parent plants and selecting progeny of the cross that have higher saccharification efficiency relative to the saccharification efficiency of at least one of the parents, or selecting progeny of the cross that have a higher sucrose content relative to the sucrose content of at least one of the parents.

Techniques suitable for use in a plant breeding program are known in the art and include, without limitation, backcrossing, polycrossing, mass selection, pedigree breeding, bulk selection, crossing to another population and recurrent selection. These techniques can be used alone or in combination with one or more other techniques in a breeding program.

The number of plants used in the initial cross is chosen based on the biology of the species to be used in the method and on breeding programs suitable for that species. The monocotyledonous and dicotyledonous plants mentioned herein can be used in the breeding methods described herein. Plants such as switchgrass, *sorghum* or sudangrass, and *Miscanthus* are particularly suitable. Breeding techniques applicable to various biomass species are known in the art.

See, e.g., Allard, Principles of Plant Breeding, John Wiley & Sons, Inc. (1960); Simmonds, Principles of Crop Improvement, Longman Group Limited (1979); and, Jensen, Plant Breeding Methodology, John Wiley & Sons, Inc. (1988). For example, breeding techniques applicable to open-pollinated species such as switchgrass are known. See, e.g., Vogel and Jung, *Critical Rev. Plant Sci.* 20:15-49 (2001).

Progeny of the cross of parental plants are screened for those that have a different biomass composition relative to corresponding control plants. Progeny that can be screened include descendants of $F_1$, $F_2$, $F_3$, $F_4$, $F_5$, $F_6$ and subsequent generation plants, $BC_1$, $BC_2$, $BC_3$, and subsequent generation plants, or $F_1BC_1$, $F_1BC_2$, $F_1BC_3$, and subsequent generation plants. Those progeny that have a difference in biomass composition are selected for further breeding.

Selection can be applied beginning with the $F_1$ generation progeny, or can be applied beginning with progeny of a subsequent generation. For example, an open-pollinated population can utilize a program of selection with progeny testing. Examples of selection with progeny testing breeding programs for switchgrass include Restricted Recurrent Phenotypic Selection (RRPS) and Between and Within Half-Sib Family Selection (B&WFS). Alternatively, a program of mass selection can be used. In mass selection, desirable individual plants are chosen, seed harvested, and the seed composited without testing to produce the next generation. Since selection is based on the maternal parent only, and there is no control over pollination, mass selection amounts to a form of random mating with selection. Mass selection typically increases the proportion of desired genotypes in the population.

As another alternative, plants of an open-pollinated species can be used as parents in an initial cross to generate a synthetic variety. A synthetic variety is produced by crossing several parental plants. The number of parental plant varieties, populations, wild accessions, ecotypes, and the like, that are used to generate a synthetic can vary from as little as 10 to as many as 500. Typically, about 100 to 300 varieties, populations, etc., are used parents to generate a synthetic variety. Seed from the parental seed production plot of a synthetic variety can subsequently undergo one or two generations of multiplication, depending on the amount of seed produced in the parental plot before being subjected to selection as discussed herein.

Selection and/or screening can be carried out over one or more generations, and/or in more than one geographic location. In addition, selection and/or screening can be applied during a particular developmental stage in which the phenotype is expected to be exhibited by the plant. Selection and/or screening is carried out to choose those plants having a statistically significant difference in biomass composition relative to a control plant or to the average of a control population and/or those plants having a statistically significant difference in conversion efficiency relative to a control plant or to the average of a control population.

Plant lines and varieties obtained by the methods described herein typically have a difference in biomass composition that is statistically significantly different relative to a control at $p \leq 0.05$ with an appropriate parametric or non-parametric statistic, e.g., Chi-square test, Student's t-test, Mann-Whitney test, or F-test. In some embodiments, the difference is statistically significant at $p<0.01$, $p<0.005$, or $p<0.001$.

In some cases, selection for other useful traits is also carried out, e.g., selection for fungal resistance or drought tolerance. Selection for such other traits can be carried out before, during or after identification of individual plants that possess a difference in biomass composition.

III. POLYPEPTIDES

Polypeptides described herein include biomass composition-modulating polypeptides. In some embodiments, biomass composition-modulating polypeptides are effective to modulate biomass composition when expressed in a plant or plant cell. In some embodiments, reduced expression of biomass composition-modulating polypeptides is effective to modulate biomass composition in a plant or plant cell. Such polypeptides typically contain at least one domain indicative of a biomass composition-modulating polypeptide, as described in more detail herein. Biomass composition-modulating polypeptides also typically have an HMM bit score that is greater than 65 as described in more detail herein. In some embodiments, biomass composition-modulating polypeptides have greater than 80% identity to SEQ ID NOs: 1, 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 99, 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 188, 189, 190, 191, 193, 194, 195, 196, 197, 198, 199, 201, 202, 203, 204, 205, 206, 207, 208, 209, 211, 213, 215, 216, 217, 219, 220, 221, 222, 224, 225, 226, 228, 230, 231, 232, 233, 235, 236, 238, 239, 240, 241, 242, 243, 244, 245, 247, 248, 249, 250, 251, 252, 254, 255, 256, 257, 258, 259, 260, 261, 262, 264, 265, 266, 267, 268, 269, 270, 272, 273, 274, 275, 276, 277, 278, 279, 280, 282, 283, 284, 285, 286, 287, 288, 290, 291, 292, 293, 294, 295, 296, 297, 298, 299, 300, 301, 303, 305, 306, 308, 309, 310, 311, 313, 314, 315, 316, 317, 319, 320, 321, 322, 323, 324, 325, 326, 328, 329, 330, 332, 333, 334, 335, 336, 337, 338, 339, 340, 341, 342, 344, 346, 347, 348, 349, 350, 351, 352, 353, 354, 355, 356, 357, 358, 360, 361, 362, 363, 364, 365, 367, 368, 370, 371, 373, 374, 375, 376, 377, 378, 379, 380, 382, 383, 384, 386, 387, 388, 389, 391, 392, 393, 394, 395, 396, 397, 398, 399, 400, 402, 403, 404, 405, 406, 407, 408, 409, 410, 412, 413, 414, 415, 417, 418, 419, 420, 421, 422, 423, 424, 425, 427, 428, 429, 430, 432, 433, 434, 435, 436, 437, 438, 440, 441, 443, 444, 445, 446, 447, 449, 451, 452, 453, 454, 456, 457, 458, 459, 460, 462, 463, 464, 465, 466, 467, 468, 469, 470, 471, 473, 475, 476, 477, 478, 479, 480, 481, 482, 483, 484, 485, 487, 488, 489, 490, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 721, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, 1139, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, or 1567 as described in more detail herein.

A. Domains Indicative of Biomass Composition-Modulating Polypeptides

A biomass composition-modulating polypeptide can contain a 2OG-Fe(II) oxygenase superfamily domain, which is predicted to be characteristic of a biomass composition-modulating polypeptide. SEQ ID NO: 471 sets forth the amino acid sequence of a *Oryza sativa* clone, identified herein as GI_115456701, that is predicted to encode a polypeptide containing a 2OG-Fe(II) oxygenase superfamily domain. For example, a biomass composition-modulating polypeptide can comprise a 2OG-Fe(II) oxygenase superfamily domain having 60 percent or greater (e.g., 65, 70, 75, 80, 85, 90, 95, 97, 98, 99, or 100 percent) sequence identity to residues 211 to 309 of SEQ ID NO: 471. In some embodiments, a biomass composition-modulating polypeptide can comprise a 2OG-Fe(II) oxygenase superfamily domain having 60 percent or greater (e.g., 65, 70, 75, 80, 85, 90, 95, 97, 98, 99, or 100 percent) sequence identity to the 2OG-Fe(II) oxygenase superfamily domain of one or more of the polypeptides set forth in SEQ ID NOs: 473, 475, 476, 477, 478, 479, 480, 481, 482, 483, 484, 485, 487, 488, 489, 490, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 721, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, and 976. The 2OG-Fe(II) oxygenase superfamily domains of such sequences are set forth in the Sequence Listing. The 2OG-Fe(II) oxygenase superfamily contains members of the 2-oxoglutarate (2OG) and Fe(II)-dependent oxygenase superfamily. See Aravind and Koonin, *Genome Biol.* 2(3): RESEARCH0007 (2001). Gibberellin (GA) 20-oxidases are a class of 2OG-dependent dioxygenases that catalyze the conversion of GA12 and GA53 to GA9 and GA20, respectively, via a three-step oxidation at C-20 of the GA skeleton, and uses iron, ascorbate, and 2-oxoglutarate as co-factors. See Oikawa, et al., *Plant Mol. Biol.* 55: 687-700 (2004).

A biomass composition-modulating polypeptide can contain an alpha/beta hydrolase fold (Abhydrolase_3) domain and a carboxylesterase (CO esterase) domain, which are predicted to be characteristic of a biomass composition-modulating polypeptide. A polypeptide containing such Abhydrolase_3 and CO esterase domains can be useful, for example, for modulating sugar content or conversion efficiency. SEQ ID NO: 99 sets forth the amino acid sequence of an *Oryza sativa* clone, identified herein as GI_75324272 that is predicted to encode a polypeptide containing Abhydrolase_3 and CO esterase domains. For example, a biomass composition-modulating polypeptide can comprise an Abhydrolase_3 domain having 60 percent or greater (e.g., 65, 70, 75, 80, 85, 90, 95, 97, 98, 99, or 100 percent) sequence identity to residues 116 to 329 of SEQ ID NO: 99 and a CO esterase domain having 60 percent or greater (e.g., 65, 70, 75, 80, 85, 90, 95, 97, 98, 99, or 100 percent) sequence identity to residues 110 to 210 of SEQ ID NO: 99. In some embodiments, a biomass composition-modulating polypeptide can comprise an Abhydrolase_3 domain and a CO esterase domain having 60 percent or greater (e.g., 65, 70, 75, 80, 85, 90, 95, 97, 98, 99, or 100 percent) sequence identity to the Abhydrolase_3 and CO esterase domains of one or more of the polypeptides set forth in SEQ ID NOs: 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, and 1139. The Abhydrolase_3 and CO esterase domains of such sequences are set forth in the Sequence Listing. The alpha/beta hydrolase fold is common to a number of hydrolytic enzymes of differing phylogenetic origin and catalytic function (e.g., proteases, lipases, peroxidases, esterases, epoxide hydrolases and dehalogenases). The core of each enzyme is an alpha/beta-sheet, rather than a barrel, containing 8 strands connected by helices. See, Ollis et al., *Protein Eng.* 5 (3): 197-211 (1992); and Nardini, et al., *Curr. Opin. Struct. Biol.* 9 (6): 732-7 (1999). The CO esterases are in the family of proteins containing an Alpha/beta hydrolase fold.

A biomass composition-modulating polypeptide can be a GID1 GA receptor and can contain one or more N-terminal helical GID1 regions, DELLA protein-interacting sites, and GA-binding amino acids as described in Voegele et al., *J. Exp. Botany* 62(14):5131-5147 (2011). For example, a biomass composition-modulating polypeptide can be a GID1 GA receptor and can contain include an alpha-helix a corresponding to approximately residues 9 to 13 of SEQ ID NO:1072, an alpha-helix b corresponding to approximately residues 18 to 34 of SEQ ID NO:1072, an alpha-helix c corresponding to approximately residues 42 to 49 of SEQ ID NO:1072, DELLA protein-interacting sites corresponding to approximately residues 6 to 7, 9, 18 to 19, 21 to 23, 25 to 30, 32, 44 to 45, 48 to 49, 51, 125 to 126, 129, and/or 322 to 326 of SEQ ID NO: 1072, GA-binding amino acids corresponding to approximately residues 24, 27, 28, 31, 35, 113 to 116, 126, 127, 191, 238, 239, 243, 244, 247, 320, 322, and/or 323 of SEQ ID NO: 1072, and HGG GA-binding amino acid motif corresponding to approximately residues 114 to 116 of SEQ ID NO: 1072, and/or a GXSXG motif corresponding to approximately residues 189 to 193 of SEQ ID NO: 1072.

A biomass composition-modulating polypeptide can contain a GRAS family transcription factor domain (GRAS) and a transcriptional regulator DELLA protein N terminal domain (DELLA), which are predicted to be characteristic of a biomass composition-modulating polypeptide. Decreased expression of a polypeptide containing such domains can be useful, for example, for modulating sugar content and/or conversion efficiency. SEQ ID NO: 188 sets forth the amino acid sequence of an *Oryza sativa* clone, identified herein as GI_75139772 that is predicted to encode a polypeptide containing a GRAS domain and a DELLA domain. For example, a biomass composition-modulating polypeptide can comprise a GRAS domain having 60 percent or greater (e.g., 65, 70, 75, 80, 85, 90, 95, 97, 98, 99, or 100 percent) sequence identity to residues 168 to 528 of SEQ ID NO: 188 and a DELLA domain having 60 percent or greater (e.g., 65, 70, 75, 80, 85, 90, 95, 97, 98, 99, or 100 percent) sequence identity to residues 27 to 97 of SEQ ID NO: 188. In some embodiments, a biomass composition-modulating polypeptide can comprise a GRAS domain and a DELLA domain having 60 percent or greater (e.g., 65, 70, 75, 80, 85, 90, 95, 97, 98, 99, or 100 percent) sequence identity to the GRAS and DELLA domains of one or more of the polypeptides set forth in SEQ ID NOs: 189, 190, 191, 193, 194, 195, 196, 197, 198, 199, 201, 202, 203, 204, 205, 206, 207, 208, 209, 211, 213, 215, 216, 217, 219, 220, 221, 222, 224, 225, 226, 228, 230, 231, 232, 233, 235, 236, 238, 239, 240, 241, 242, 243, 244, 245, 247, 248, 249, 250, 251, 252, 254, 255, 256, 257, 258, 259, 260, 261, 262, 264, 265, 266, 267, 268, 269, 270, 272, 273, 274, 275, 276, 277, 278, 279, 280, 282, 283, 284, 285, 286, 1009, 1010, 1011, 1012, 1013, 1014, 1015, 1016, 1017, 1018, 1019, 1020, 1021, 1022, and 1023. Transcription factors in the GRAS family share a variable amino-terminus and a highly conserved carboxyl-terminus that contains five recognizable motifs. The transcription factors may be involved in development and other processes. See, e.g., Pysh et al., *Plant J.,* 18:111-119 (1999); and Bolle, et al., *Genes Dev.,* 14:1269-1278 (2000). DELLA proteins are transcriptional regulators that are down regulated when gibberellins bind to a nuclear receptor GIBBERELLIN INSENSITIVE DWARF1 (GID1). GID1 forms a complex with DELLA proteins and targets the DELLA proteins for degradation through the 26S proteasome. The N terminal of DELLA proteins contains conserved DELLA and VHYNP motifs that are important for GID1 binding and proteolysis of the DELLA proteins. See, Murase, et al., Nature, 456:459-463 (2008).

A biomass composition-modulating polypeptide can contain a 2OG-Fe(II) oxygenase superfamily domain, which is predicted to be characteristic of a biomass composition-modulating polypeptide. A polypeptide containing such a domain can be useful, for example, for modulating sugar content or conversion efficiency. SEQ ID NO: 1 sets forth the amino acid sequence of a *Triticum aestivum* clone, identified herein as GI_85540948, that is predicted to encode a polypeptide containing a 2OG-Fe(II) oxygenase superfamily domain. For example, a biomass composition-modulating polypeptide can comprise a 2OG-Fe(II) oxygenase superfamily domain having 60 percent or greater (e.g., 65, 70, 75, 80, 85, 90, 95, 97, 98, 99, or 100 percent) sequence identity to residues 209 to 306 of SEQ ID NO: 1. In some embodiments, a biomass composition-modulating polypeptide can comprise a 2OG-Fe(II) oxygenase superfamily domain having 60 percent or greater (e.g., 65, 70, 75, 80, 85, 90, 95, 97, 98, 99, or 100 percent) sequence identity to the 2OG-Fe(II) oxygenase superfamily domain of one or more of the polypeptides set forth in SEQ ID NOs: 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, and 1008. The 2OG-Fe(II) oxygenase superfamily domain of such sequences are set forth in the Sequence Listing. The 2OG-Fe(II) oxygenase superfamily is described above. GA 3-oxidases are a class of 2OG-dependent dioxygenases, classified under EC 1.14.11.15, that convert GA9 and GA20 to GA4 and GA1, respectively. See, Oikawa, et al., 2004, supra.

A biomass composition-modulating polypeptide can contain a 2OG-Fe(II) oxygenase superfamily domain, which is predicted to be characteristic of a biomass composition-modulating polypeptide. Decreased expression of a polypeptide containing such a domain can be useful, for example, for modulating sugar content or conversion efficiency. SEQ ID NO: 287 sets forth the amino acid sequence of a *Arabidopsis thaliana* clone, identified herein as G2OX1_ARATH, that is predicted to encode a polypeptide containing a 2OG-Fe(II) oxygenase superfamily domain. For example, a biomass composition-modulating polypeptide can comprise a 2OG-Fe(II) oxygenase superfamily domain having 60 percent or greater (e.g., 65, 70, 75, 80, 85, 90, 95, 97, 98, 99, or 100 percent) sequence identity to residues 167 to 273 of SEQ ID NO: 287. In some embodiments, a biomass composition-modulating polypeptide can comprise a 2OG-Fe(II) oxygenase superfamily domain having 60 percent or greater (e.g., 65, 70, 75, 80, 85, 90, 95, 97, 98, 99, or 100 percent) sequence identity to the 2OG-Fe(II) oxygenase superfamily domain of one or more of the polypeptides set forth in SEQ ID NOs: 288, 290, 291, 292, 293, 294, 295, 296, 297, 298, 299, 300, 301, 303, 305, 306, 308, 309, 310, 311, 313, 314, 315, 316, 317, 319, 320, 321, 322, 323, 324, 325, 326, 328, 329, 330, 332, 333, 334, 335, 336, 337, 338, 339, 340, 341, 342, 344, 346, 347, 348, 349, 350, 351, 352, 353, 354, 355, 356, 357, 358, 360, 361, 362, 363, 364, 365, 367, 368, 370, 371, 373, 374, 375, 376, 377, 378, 379, 380, 382, 383, 384, 386, 387, 388, 389, 391, 392, 393, 394, 395, 396, 397, 398, 399, 400, 402, 403, 404, 405, 406, 407, 408, 409, 410, 412, 413, 414, 415, 417, 418, 419, 420, 421, 422, 423, 424, 425, 427, 428, 429, 430, 432, 433, 434, 435, 436, 437, 438, 440, 441, 443, 444, 445, 446, 447, 449, 451, 452, 453, 454, 456, 457, 458, 459, 460, 462, 463, 464, 465, 466, 467, 468, 469, 470, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, and 1273. The 2OG-Fe(II) oxygenase superfamily domain of such sequences are set forth in the Sequence Listing. The 2OG-Fe(II) oxygenase superfamily is described above. GA 2-oxidases are a class of 2OG-dependent dioxygenases, classified under EC 1.14.11.13, that inactivate GAs by 2 beta-hydroxylation. See, Hedden and Phillips, Trends Plant Sci., 5:523-530 (2000).

A biomass composition-modulating polypeptide can contain a cytochrome P450 domain, which is predicted to be characteristic of a biomass composition-modulating polypeptide. Decreased expression of a polypeptide containing such a domain can be useful, for example, for modulating sugar content or conversion efficiency. SEQ ID NO: 1429 sets forth the amino acid sequence of a *Gibberella intermedia* clone, identified herein as cytochrome P450 or CYP68B1 or GiGA20-oxidase, that is predicted to encode a polypeptide containing a Cytochrome P450 domain. For example, a biomass composition-modulating polypeptide can comprise a cytochrome P450 domain having 60 percent or greater (e.g., 65, 70, 75, 80, 85, 90, 95, 97, 98, 99, or 100 percent) sequence identity to residues 142 to 500 of SEQ ID NO: 1429. In some embodiments, a biomass composition-modulating polypeptide can comprise a cytochrome P450 domain having 60 percent or greater (e.g., 65, 70, 75, 80, 85, 90, 95, 97, 98, 99, or 100 percent) sequence identity to the cytochrome P450 domain of one or more of the polypeptides set forth in SEQ ID NOs: 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, and 1541. The cytochrome P450 domains of such sequences are set forth in the Sequence Listing. The Cytochrome P450 family is described by, for example, Pinot and Beisson, FEBS J., 78(2):195-205 (2011).

A biomass composition-modulating polypeptide can contain a Cytochrome P450 domain, which is predicted to be characteristic of a biomass composition-modulating polypeptide. Decreased expression of a polypeptide containing such a domain can be useful, for example, for modulating sugar content or conversion efficiency. SEQ ID NO: 1386 sets forth the amino acid sequence of a *Gibberella intermedia* clone, identified herein as cytochrome P450 or GA14-synthase, that is predicted to encode a polypeptide containing a cytochrome P450 domain. For example, a biomass composition-modulating polypeptide can comprise a cytochrome P450 domain having 60 percent or greater (e.g., 65, 70, 75, 80, 85, 90, 95, 97, 98, 99, or 100 percent) sequence identity to residues 176 to 504 of SEQ ID NO: 1386. In some embodiments, a biomass composition-modulating polypeptide can comprise a Cytochrome P450 domain having 60 percent or greater (e.g., 65, 70, 75, 80, 85, 90, 95, 97, 98, 99, or 100 percent) sequence identity to the Cytochrome P450 domain of one or more of the polypeptides set forth in SEQ ID NOs: 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, and 1428. The cytochrome P450 domains of such sequences are set forth in the Sequence Listing. The Cytochrome P450 family is described, for example, by Pinot and Beisson, *FEBS J.*, 78(2):195-205 (2011).

A biomass composition-modulating polypeptide can contain a cytochrome P450 domain, which is predicted to be characteristic of a biomass composition-modulating polypeptide. Decreased expression of a polypeptide containing such a domain can be useful, for example, for modulating sugar content or conversion efficiency. SEQ ID NO: 1274 sets forth the amino acid sequence of a *Gibberella intermedia* clone, identified herein as cytochrome P450 or CYP69A1 or C13-oxidase, that is predicted to encode a polypeptide containing a cytochrome P450 domain. For example, a biomass composition-modulating polypeptide can comprise a cytochrome P450 domain having 60 percent or greater (e.g., 65, 70, 75, 80, 85, 90, 95, 97, 98, 99, or 100 percent) sequence identity to residues 98 to 368 of SEQ ID NO: 1274. In some embodiments, a biomass composition-modulating polypeptide can comprise a cytochrome P450 domain having 60 percent or greater (e.g., 65, 70, 75, 80, 85, 90, 95, 97, 98, 99, or 100 percent) sequence identity to the Cytochrome P450 domain of one or more of the polypeptides set forth in SEQ ID NOs: 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, and 1385. The cytochrome P450 domains of such sequences are set forth in the Sequence Listing. The Cytochrome P450 family is described, for example, by Pinot and Beisson, *FEBS J.*, 78(2):195-205 (2011).

In some embodiments, a biomass composition-modulating polypeptide is truncated at the amino- or carboxy-terminal end of a naturally occurring polypeptide. A truncated polypeptide may retain certain domains of the naturally occurring polypeptide while lacking others. Thus, length variants that are up to 5 amino acids shorter or longer typically exhibit the biomass composition-modulating activity of a truncated polypeptide. In some embodiments, a truncated polypeptide is a dominant negative polypeptide. Expression in a plant of such a truncated polypeptide confers a difference in biomass composition of a plant as compared to the corresponding level of a control plant that does not comprise the truncation.

B. Functional Homologs Identified by Reciprocal BLAST®

In some embodiments, one or more functional homologs of a reference biomass composition-modulating polypeptide defined by one or more of the Pfam descriptions indicated above are suitable for use as biomass composition-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a biomass composition-modulating polypeptide, or by combining domains from the coding sequences for different naturally-occurring biomass composition-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of biomass composition-modulating polypeptides. Sequence analysis can involve BLAST®, Reciprocal BLAST®, or PSI-BLAST® analysis of nonredundant databases using a biomass composition-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as a biomass composition-modulating polypeptide Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in biomass composition-modulating polypeptides, e.g., conserved functional domains.

Conserved regions can be identified by locating a region within the primary amino acid sequence of a biomass composition-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262

(1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Examples of amino acid sequences of functional homologs of the polypeptide set forth in SEQ ID NO: 471 are provided in FIG. 1 and in the Sequence Listing. Such functional homologs include, for example, CeresAnnot_8631464_Sb (SEQ ID NO: 473), CeresClone_329121_Zm (SEQ ID NO: 475), GI_75276875_Ta (SEQ ID NO: 476), GI_13625523_Lp (SEQ ID NO: 477), GI_49065946_Hv (SEQ ID NO: 478), GI_157683559_Dasypyrum_villosum (SEQ ID NO: 479), GI_4164141_Lactuca_sativa (SEQ ID NO: 480), GI_187455574_Helianthus_annuus (SEQ ID NO: 481), GI_190192210_Chrysanthemum (SEQ ID NO: 482), GI_7328337_Solanum_dulcamara (SEQ ID NO: 483), GI_8919865_Citrus (SEQ ID NO: 484), GI_326581983_Capsicum_annuum (SEQ ID NO: 485), CeresClone_1842451 Gh (SEQ ID NO: 487), GI_99032729_Vitis_vinifera (SEQ ID NO: 488), GI_3327245_Nicotiana_tabacum (SEQ ID NO: 489), GI_34013374_Populus_alba (SEQ ID NO: 490), GI_303303656_Ipomoea_nil (SEQ ID NO: 491), GI_18496057_Fagus_sylvatica (SEQ ID NO: 492), GI_255541396_Ricinus_communis (SEQ ID NO: 493), CeresAnnot_878887_Arabidopsis_thaliana (SEQ ID NO: 495), GI_210142296 (SEQ ID NO: 496), CeresAnnot_8669917 (SEQ ID NO: 498), GI_15242189 (SEQ ID NO: 499), GI_255927093 (SEQ ID NO: 500), GI_67462129 (SEQ ID NO: 501), GI_10800974 (SEQ ID NO: 502), GI_6855711 (SEQ ID NO: 503), GI_223943497 (SEQ ID NO: 504), GI_210142300 (SEQ ID NO: 505), GI_255927115 (SEQ ID NO: 506), CeresAnnot_1497117 (SEQ ID NO: 508), GI_255927101 (SEQ ID NO: 509), GI_335056045 (SEQ ID NO: 510), GI_125546514 (SEQ ID NO: 511), GI_208609486 (SEQ ID NO: 512), GI_20149239 (SEQ ID NO: 513), GI_109452794 (SEQ ID NO: 514), GI_255927111 (SEQ ID NO: 515), CeresAnnot_881675 (SEQ ID NO: 517), GI_9791186 (SEQ ID NO: 518), GI_255927119 (SEQ ID NO: 519), GI_255927105 (SEQ ID NO: 520), GI_30102973 (SEQ ID NO: 521), GI_1854637 (SEQ ID NO: 522), GI_210142292 (SEQ ID NO: 523), GI_82568041 (SEQ ID NO: 524), GI_297795983 (SEQ ID NO: 525), GI_255927103 (SEQ ID NO: 526), GI_62320340 (SEQ ID NO: 527), GI_125546516 (SEQ ID NO: 528), GI_77632796 (SEQ ID NO: 529), GI_125528619 (SEQ ID NO: 530), GI_335056055 (SEQ ID NO: 531), GI_255927121 (SEQ ID NO: 532), GI_210142286 (SEQ ID NO: 533), GI_147782450 (SEQ ID NO: 534), GI_226492950 (SEQ ID NO: 535), GI_218196824 (SEQ ID NO: 536), GI_15219842 (SEQ ID NO: 537), GI_2108432 (SEQ ID NO: 538), GI_4164143 (SEQ ID NO: 539), GI_297724127 (SEQ ID NO: 540), GI_21322508 (SEQ ID NO: 541), GI_162458757 (SEQ ID NO: 542), CeresClone_100845866 (SEQ ID NO: 544), GI_242055211 (SEQ ID NO: 545), GI_210142298 (SEQ ID NO: 546), GI_326529611 (SEQ ID NO: 547), GI_1109695 (SEQ ID NO: 548), GI_169403818 (SEQ ID NO: 549), GI_2108428 (SEQ ID NO: 550), GI_1848146 (SEQ ID NO: 551), GI_210142288 (SEQ ID NO: 552), GI_13625525 (SEQ ID NO: 553), GI_188474853 (SEQ ID NO: 554), GI_75276876 (SEQ ID NO: 555), GI_335056059 (SEQ ID NO: 556), CeresClone_624633 (SEQ ID NO: 558), GI_210142302 (SEQ ID NO: 559), CeresClone_818172 (SEQ ID NO: 561), GI_297810833 (SEQ ID NO: 562), GI_115441469 (SEQ ID NO: 563), GI_27124556 (SEQ ID NO: 564), CeresClone_639483 (SEQ ID NO: 566), GI_255927091 (SEQ ID NO: 567), GI_48475183 (SEQ ID NO: 568), GI_13625519 (SEQ ID NO: 569), GI_210142290 (SEQ ID NO: 570), GI_30519873 (SEQ ID NO: 571), GI_225453833 (SEQ ID NO: 572), GI_297201566 (SEQ ID NO: 573), GI_159902527 (SEQ ID NO: 574), GI_302797527 (SEQ ID NO: 575), GI_168044400 (SEQ ID NO: 576), GI_233142142 (SEQ ID NO: 577), GI_330985521 (SEQ ID NO: 578), GI_225431689 (SEQ ID NO: 579), GI_168015263 (SEQ ID NO: 580), CeresAnnot_1474270 (SEQ ID NO: 582), GI_296089115 (SEQ ID NO: 583), GI_89574456 (SEQ ID NO: 584), GI_295691295 (SEQ ID NO: 585), GI_219362733 (SEQ ID NO: 586), GI_147865914 (SEQ ID NO: 587), GI_53139594 (SEQ ID NO: 588), GI_187455576 (SEQ ID NO: 589), GI_320462770 (SEQ ID NO: 590), CeresAnnot_1503804 (SEQ ID NO: 592), GI_198286468 (SEQ ID NO: 593), GI_4321498 (SEQ ID NO: 594), GI_118470389 (SEQ ID NO: 595), CeresClone_539430 (SEQ ID NO: 597), CeresClone_518341 (SEQ ID NO: 599), GI_89574455 (SEQ ID NO: 600), GI_330958505 (SEQ ID NO: 601), GI_254419812 (SEQ ID NO: 602), CeresAnnot_1452184 (SEQ ID NO: 604), GI_86605411 (SEQ ID NO: 605), GI_329847655 (SEQ ID NO: 606), GI_237682458 (SEQ ID NO: 607), GI_49065948 (SEQ ID NO: 608), GI_255558510 (SEQ ID NO: 609), GI_326332772 (SEQ ID NO: 610), CeresClone_473318 (SEQ ID NO: 612), GI_116785413 (SEQ ID NO: 613), GI_297242535 (SEQ ID NO: 614), GI_195976661 (SEQ ID NO: 615), CeresAnnot_8644543 (SEQ ID NO: 617), GI_125486693 (SEQ ID NO: 618), GI_53139630 (SEQ ID NO: 619), GI_109729787 (SEQ ID NO: 620), GI_53139646 (SEQ ID NO: 621), GI_53139614 (SEQ ID NO: 622), GI_12320815 (SEQ ID NO: 623), GI_256420048 (SEQ ID NO: 624), GI_255583171 (SEQ ID NO: 625), GI_159902523 (SEQ ID NO: 626), GI_213876865 (SEQ ID NO: 627), GI_195976665 (SEQ ID NO: 628), GI_1666094 (SEQ ID NO: 629), GI_9650811 (SEQ ID NO: 630), GI_2108434 (SEQ ID NO: 631), GI_167644154 (SEQ ID NO: 632), GI_302882991 (SEQ ID NO: 633), GI_160623443 (SEQ ID NO: 634), GI_311899282 (SEQ ID NO: 635), GI_125572881 (SEQ ID NO: 636), GI_53139590 (SEQ ID NO: 637), GI_55978167 (SEQ ID NO: 638), GI_331699132 (SEQ ID NO: 639), GI_325106136 (SEQ ID NO: 640), GI_53139664 (SEQ ID NO: 641), CeresClone_1827193 (SEQ ID NO: 643), GI_160623445 (SEQ ID NO: 644), GI_134075373 (SEQ ID NO: 645), GI_222875436 (SEQ ID NO: 646), GI_2224890 (SEQ ID NO: 647), GI_226305722 (SEQ ID NO: 648), GI_50428327 (SEQ ID NO: 649), GI_302797040 (SEQ ID NO: 650), GI_104295012 (SEQ ID NO: 651), GI_159043926 (SEQ ID NO: 652), GI_254253748 (SEQ ID NO: 653), GI_60498576 (SEQ ID NO: 654), GI_297852192 (SEQ ID NO: 655), GI_302141747 (SEQ ID NO: 656), GI_111224710 (SEQ ID NO: 657), GI_53139592 (SEQ ID NO: 658), GI_320324375 (SEQ ID NO: 659), GI_68509984 (SEQ ID NO: 660), GI_339470611 (SEQ ID NO: 661), CeresAnnot_1468944 (SEQ ID NO: 663), GI_330890071 (SEQ ID NO: 664), GI_225459697 (SEQ ID NO: 665), GI_239817805 (SEQ ID NO: 666), GI_195976667 (SEQ ID NO: 667), GI_51011360 (SEQ ID NO: 668), GI_255572455 (SEQ ID NO: 669), GI_189409355 (SEQ ID NO: 670), GI_302800904 (SEQ ID NO: 671), GI_168012845 (SEQ ID NO: 672), GI_217037949 (SEQ ID NO: 673), GI_312195518 (SEQ ID NO: 674), GI_4321496 (SEQ ID NO: 675), GI_5359492 (SEQ ID NO: 676), GI_53139608 (SEQ ID NO: 677), GI_320588046 (SEQ ID NO: 678), GI_53139640 (SEQ ID NO: 679), GI_333440997 (SEQ ID NO: 680), GI_325189696 (SEQ ID NO: 681), GI_4321494 (SEQ ID NO: 682), GI_53139588 (SEQ ID NO: 683), GI_325184325 (SEQ ID NO: 684), GI_255556241 (SEQ ID NO: 685), GI_302790077 (SEQ ID NO: 686), CeresAnnot_1444168 (SEQ ID NO: 688), GI_159902531 (SEQ ID NO: 689), GI_3402332 (SEQ ID NO: 690), GI_294011471 (SEQ ID NO: 691), GI_320462774 (SEQ ID NO: 692), GI_255556243 (SEQ ID NO: 693), CeresAnnot_1456250 (SEQ ID NO: 695), GI_320462772 (SEQ ID NO: 696), GI_187729689 (SEQ ID NO: 697), GI_114570248 (SEQ ID NO: 698), GI_74273643 (SEQ ID NO: 699), GI_317029127 (SEQ ID NO: 700), GI_1381673 (SEQ ID NO: 701), GI_317158331 (SEQ ID NO: 702), GI_168041562 (SEQ ID NO: 703), CeresClone_1647898 (SEQ ID NO: 705), GI_168004189 (SEQ ID NO: 706), GI_195976671 (SEQ ID NO: 707), GI_168033355 (SEQ ID NO: 708), GI_255637063 (SEQ ID NO: 709), GI_218764876 (SEQ ID NO: 710), GI_47499085 (SEQ ID NO: 711), GI_229489577 (SEQ ID NO: 712), GI_53139616 (SEQ ID NO: 713), GI_16124455 (SEQ ID NO: 714), GI_92115002 (SEQ ID NO: 715), GI_262200288 (SEQ ID NO: 716), GI_53139668 (SEQ ID NO: 717), GI_20149241 (SEQ ID NO: 718), GI_311109251 (SEQ ID NO: 719), GI_222875432 (SEQ ID NO: 720), GI_190192208 (SEQ ID NO: 721), CeresClone_1370404 (SEQ ID NO: 723), GI_298486918 (SEQ ID NO: 724), GI_53139624 (SEQ ID NO: 725), GI_40233167 (SEQ ID NO: 726), GI_301123383 (SEQ ID NO: 727), GI_48057695 (SEQ ID NO: 728), GI_168050680 (SEQ ID NO: 729), GI_29831348 (SEQ ID NO: 730), GI_115470777 (SEQ ID NO: 731), GI_255642379 (SEQ ID NO: 732), GI_302797547 (SEQ ID NO: 733), GI_53139648 (SEQ ID NO: 734), GI_326385638 (SEQ ID NO: 735), GI_147916856 (SEQ ID NO: 736), GI_486625 (SEQ ID NO: 737), GI_197090668 (SEQ ID NO: 738), GI_154705630 (SEQ ID NO: 739), GI_168032021 (SEQ ID NO: 740), GI_58700543 (SEQ ID NO: 741), GI_317454944 (SEQ ID NO: 742), GI_198286476 (SEQ ID NO: 743), GI_332531325 (SEQ ID NO: 744), GI_302821145 (SEQ ID NO: 745), GI_255927085 (SEQ ID NO: 746), GI_8778664 (SEQ ID NO: 747), GI_229490954 (SEQ ID NO: 748), GI_255927099 (SEQ ID NO: 749), GI_34013370 (SEQ ID NO: 750), GI_225455655 (SEQ ID NO: 751), GI_168046914 (SEQ ID NO: 752), CeresClone_156575 (SEQ ID NO: 754), CeresClone_1962928 (SEQ ID NO: 756), GI_37359180 (SEQ ID NO: 757), US20040010815-0080 (SEQ ID NO: 758), GI_308810887 (SEQ ID NO: 759), GI_296084082 (SEQ ID NO: 760), GI_102139962 (SEQ ID NO: 761), GI_46127407 (SEQ ID NO: 762), GI_255927107 (SEQ ID NO: 763), GI_13625521 (SEQ ID NO: 764), GI_224083474 (SEQ ID NO: 765), CeresAnnot_1509446 (SEQ ID NO: 767), GI_28316358 (SEQ ID NO: 768), GI_302821073 (SEQ ID NO: 769), GI_217037951 (SEQ ID NO: 770), CeresClone_526491 (SEQ ID NO: 772), GI_224082360 (SEQ ID NO: 773), CeresAnnot_835213 (SEQ ID NO: 775), GI_53139612 (SEQ ID NO: 776), GI_224120176 (SEQ ID NO: 777), GI_210142294 (SEQ ID NO: 778), GI_9971219 (SEQ ID NO: 779), GI_326475334 (SEQ ID NO: 780), GI_255539617 (SEQ ID NO: 781), GI_255927109 (SEQ ID NO: 782), GI_186695270 (SEQ ID NO: 783), GI_10800976 (SEQ ID NO: 784), GI_255927097 (SEQ ID NO: 785), CeresClone_100062984 (SEQ ID NO: 787), GI_115361480 (SEQ ID NO: 788), GI_2262201 (SEQ ID NO: 789), GI_3327247 (SEQ ID NO: 790), GI_335056001 (SEQ ID NO: 791), GI_111225835 (SEQ ID NO: 792), GI_317106632 (SEQ ID NO: 793), GI_255927087 (SEQ ID NO: 794), GI_9791188 (SEQ ID NO: 795), GI_9791187 (SEQ ID NO: 796), GI_146270975 (SEQ ID NO: 797), CeresAnnot_8732690 (SEQ ID NO: 799), GI_51011362 (SEQ ID NO: 800), GI_303283824 (SEQ ID NO: 801), GI_320589215 (SEQ ID NO: 802), GI_255927089 (SEQ ID NO: 803), GI_330992883 (SEQ ID NO: 804), GI_222875434 (SEQ ID NO: 805), GI_53139620 (SEQ ID NO: 806), GI_297799454 (SEQ ID NO: 807), GI_304570785 (SEQ ID NO: 808), GI_89574458 (SEQ ID NO: 809), GI_238507652 (SEQ ID NO: 810), CeresAnnot_1471005 (SEQ ID NO: 812), WO2011060920-24495 (SEQ ID NO: 813), GI_50428325 (SEQ ID NO: 814), GI_60390163 (SEQ ID NO: 815), GI_158392463 (SEQ ID NO: 816), GI_1144390 (SEQ ID NO: 817), GI_225431709 (SEQ ID NO: 818), CeresAnnot_8461546 (SEQ ID NO: 820), GI_255573359 (SEQ ID NO: 821), GI_302759260 (SEQ ID NO: 822), GI_16118889 (SEQ ID NO: 823), GI_217072494 (SEQ ID NO: 824), GI_340519930 (SEQ ID NO: 825), GI_301123381 (SEQ ID NO: 826), GI_53139652 (SEQ ID NO:827), GI_302790059 (SEQ ID NO:828), GI_257484083 (SEQ ID NO:829), GI_12231168 (SEQ ID NO:830), GI_82568007 (SEQ ID NO:831), GI_53139654 (SEQ ID NO: 832), GI_255927117 (SEQ ID NO: 833), GI_119501723 (SEQ ID NO: 834), GI_189206996 (SEQ ID NO: 835), GI_60498578 (SEQ ID NO: 836), GI_15422154 (SEQ ID NO: 837), GI_198286472 (SEQ ID NO: 838), GI_255927113 (SEQ ID NO: 839), CeresClone_1101515 (SEQ ID NO: 841), GI_208609488 (SEQ ID NO: 842), GI_197103783 (SEQ ID NO: 843), GI_53139600 (SEQ ID NO: 844), GI_1581592 (SEQ ID NO: 845), GI_302381882 (SEQ ID NO: 846), GI_198286480 (SEQ ID NO: 847), CeresAnnot_1522333 (SEQ ID NO: 849), GI:225465379 (SEQ ID NO: 850), GI:357114308 (SEQ ID NO: 851), GI:242076892 (SEQ ID NO: 852), GI:255548069 (SEQ ID NO: 853), GI:356521217 (SEQ ID NO: 854), GI:147865705 (SEQ ID NO: 855), GI:350540006 (SEQ ID NO: 856), GI:326491817 (SEQ ID NO: 857), GI:225426514 (SEQ ID NO: 858), GI:225453648 (SEQ ID NO: 859), GI:226498686 (SEQ ID NO: 860), GI:326494732 (SEQ ID NO: 861), GI:116311010 (SEQ ID NO: 862), GI:115460102 (SEQ ID NO: 863), GI:242040385 (SEQ ID NO: 864), GI:116783156 (SEQ ID NO: 865), GI:297808467 (SEQ ID NO: 866), GI:116791020 (SEQ ID NO: 867), GI:302769898 (SEQ ID NO: 868), GI:116793430 (SEQ ID NO: 869), GI:18402081 (SEQ ID NO: 870), GI:116792100 (SEQ ID NO: 871), GI:168014854 (SEQ ID NO: 872), GI:194703858 (SEQ ID NO: 873), GI:357475523 (SEQ ID NO: 874), GI:116784279 (SEQ ID NO: 875), GI:116793277 (SEQ ID NO: 876), GI:294463977 (SEQ ID NO: 877), GI:357468779 (SEQ ID NO: 878), GI:268638403 (SEQ ID NO: 879), GI:159902533 (SEQ ID NO: 880), GI:224286184 (SEQ ID NO: 881), GI:357475519 (SEQ ID NO: 882), GI:125562561 (SEQ ID NO: 883), GI:116780785 (SEQ ID NO: 884), GI:116786939 (SEQ ID NO: 885), GI:357461273 (SEQ ID NO: 886), GI:222613187 (SEQ ID NO: 887), GI:357475529 (SEQ ID NO: 888), GI:168003319 (SEQ ID NO: 889), GI:297809271 (SEQ ID NO: 890), GI:224284972 (SEQ ID NO: 891), GI:297809269 (SEQ ID NO: 892), GI:116794322 (SEQ ID NO: 893), GI:116792196 (SEQ ID NO: 894), GI:357475525

(SEQ ID NO: 895), GI:357440313 (SEQ ID NO: 896), GI:313471276 (SEQ ID NO: 897), GI:357492715 (SEQ ID NO: 898), GI:255557477 (SEQ ID NO: 899), GI:358347250 (SEQ ID NO: 900), GI:357111461 (SEQ ID NO: 901), GI:255575141 (SEQ ID NO: 902), CeresAnnot:8454419 (SEQ ID NO: 904), GI:297820344 (SEQ ID NO: 905), GI:110618325 (SEQ ID NO: 906), GI:166798287 (SEQ ID NO: 907), GI:60476845 (SEQ ID NO: 908), GI:51493449 (SEQ ID NO: 909), GI:326366179 (SEQ ID NO: 910), GI:42566572 (SEQ ID NO: 911), GI:378749126 (SEQ ID NO: 912), GI:219944305 (SEQ ID NO: 913), GI:366047645 (SEQ ID NO: 914), GI:237682460 (SEQ ID NO: 915), GI:333362482 (SEQ ID NO: 916), GI:169793771 (SEQ ID NO: 917), GI:729503 (SEQ ID NO: 918), GI:80973282 (SEQ ID NO: 919), GI:21392365 (SEQ ID NO: 920), GI:222478425 (SEQ ID NO: 921), GI:164454785 (SEQ ID NO: 922), GI:46850468 (SEQ ID NO: 923), GI:225194715 (SEQ ID NO: 924), GI:355645974 (SEQ ID NO: 925), GI:113205138 (SEQ ID NO: 926), GI:2570827 (SEQ ID NO: 927), GI:300834841 (SEQ ID NO: 928), GI:157169280 (SEQ ID NO: 929), GI:348686932 (SEQ ID NO: 930), GI:223997880 (SEQ ID NO: 931), GI:194371667 (SEQ ID NO: 932), GI:297306658 (SEQ ID NO: 933), GI:158515829 (SEQ ID NO: 934), GI:241898888 (SEQ ID NO: 935), GI:62824273 (SEQ ID NO: 936), GI:520802 (SEQ ID NO: 937), GI:307727667 (SEQ ID NO: 938), GI:359359094 (SEQ ID NO: 939), GI:145248559 (SEQ ID NO: 940), GI:227536376 (SEQ ID NO: 941), GI:339495204 (SEQ ID NO: 942), GI:334344062 (SEQ ID NO: 943), GI:145352595 (SEQ ID NO: 944), GI:354570727 (SEQ ID NO: 945), GI:66043929 (SEQ ID NO: 946), GI:302884057 (SEQ ID NO: 947), GI:379063357 (SEQ ID NO: 948), GI:153011110 (SEQ ID NO: 949), GI:19115385 (SEQ ID NO: 950), GI:30060226 (SEQ ID NO: 951), GI:169615517 (SEQ ID NO: 952), GI:149280311 (SEQ ID NO: 953), GI:322705051 (SEQ ID NO: 954), GI:88856654 (SEQ ID NO: 955), GI:117617896 (SEQ ID NO: 956), GI:381201565 (SEQ ID NO: 957), GI:170089053 (SEQ ID NO: 958), GI:379655258 (SEQ ID NO: 959), GI:321253745 (SEQ ID NO: 960), GI:343425662 (SEQ ID NO: 961), GI:226294156 (SEQ ID NO: 962), GI:169768582 (SEQ ID NO: 963), GI:380602393 (SEQ ID NO: 964), GI:315044917 (SEQ ID NO: 965), GI:332529892 (SEQ ID NO: 966), GI:116695054 (SEQ ID NO: 967), GI:346974225 (SEQ ID NO: 968), GI:361126689 (SEQ ID NO: 969), GI:226292680 (SEQ ID NO: 970), GI:119478814 (SEQ ID NO: 971), GI:347829892 (SEQ ID NO: 972), GI:150951140 (SEQ ID NO: 973), GI:149245084 (SEQ ID NO: 974), GI:156064337 (SEQ ID NO: 975), and GI:242780807 (SEQ ID NO: 976). In some cases, a functional homolog of SEQ ID NO: 471 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 471. In some cases, a functional homolog of SEQ ID NO: 471 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 471 described above or set forth in the Sequence Listing.

Figure 2B:
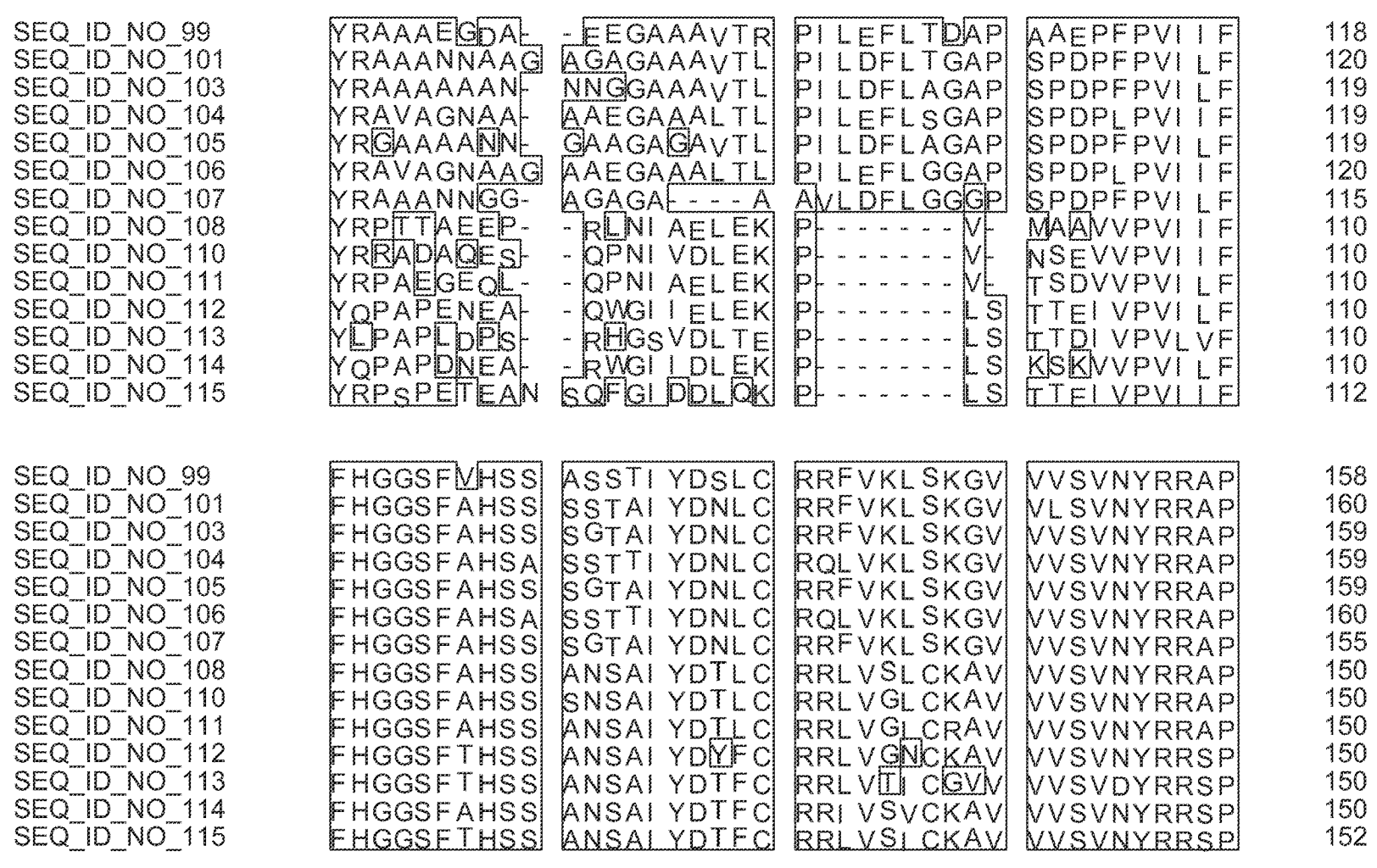

Examples of amino acid sequences of functional homologs of the polypeptide set forth in SEQ ID NO: 99 are provided in FIG. 2 and in the Sequence Listing. Such functional homologs include, for example, Ceres-Clone_1857760 (SEQ ID NO: 101), CeresAnnot_8732528 (SEQ ID NO: 103), GI_156616217 (SEQ ID NO: 104), GI_169159254 (SEQ ID NO: 105), GI_169159270 (SEQ ID NO: 106), GI_169159256 (SEQ ID NO: 107), GI_225346677 (SEQ ID NO: 108), CeresAnnot_1488901 (SEQ ID NO: 110), GI_255542494 (SEQ ID NO: 111), GI_225436847 (SEQ ID NO: 112), GI_315075933 (SEQ ID NO: 113), GI_238654635 (SEQ ID NO: 114), GI_82697973 (SEQ ID NO: 115), GI_218196784 (SEQ ID NO: 116), GI_169159258 (SEQ ID NO: 117), CeresClone_1941624 (SEQ ID NO: 119), GI_225346675 (SEQ ID NO: 120), GI_148612415 (SEQ ID NO: 121), CeresAnnot_1522790 (SEQ ID NO: 123), GI_110747150 (SEQ ID NO: 124), CeresAnnot_1469390 (SEQ ID NO: 126), GI_225346679 (SEQ ID NO: 127), GI_224068739 (SEQ ID NO: 128), GI_225346671 (SEQ ID NO: 129), CeresAnnot_1471748 (SEQ ID NO: 131), GI_147774750 (SEQ ID NO: 132), GI_15240483 (SEQ ID NO: 133), GI_225346673 (SEQ ID NO: 134), GI_298205013 (SEQ ID NO: 135), GI_255567576 (SEQ ID NO: 136), GI_307752615 (SEQ ID NO: 137), GI_297817636 (SEQ ID NO: 138), GI_15229371 (SEQ ID NO: 139), GI_15229905 (SEQ ID NO: 140), GI_307752613 (SEQ ID NO: 141), GI_169159264 (SEQ ID NO: 142), GI_307752617 (SEQ ID NO: 143), GI_297812999 (SEQ ID NO: 144), GI_238654633 (SEQ ID NO: 145), GI_308220216 (SEQ ID NO: 146), CeresAnnot_1444948 (SEQ ID NO: 148), CeresClone_1172108 (SEQ ID NO: 150), GI_169159250 (SEQ ID NO: 151), GI_169159262 (SEQ ID NO: 152), CeresClone_1924067 (SEQ ID NO: 154), GI_169159252 (SEQ ID NO: 155), GI_116794075 (SEQ ID NO: 156), GI_169159248 (SEQ ID NO: 157), GI_169159246 (SEQ ID NO: 158), GI_256772632 (SEQ ID NO: 159), GI_302794147 (SEQ ID NO: 160), GI_296086662 (SEQ ID NO: 161), GI_302782397 (SEQ ID NO: 162), GI_302787771 (SEQ ID NO: 163), GI_156446298 (SEQ ID NO: 164), CeresClone_1843446 (SEQ ID NO: 166), GI_168008743 (SEQ ID NO: 167), CeresAnnot_1449351 (SEQ ID NO: 169), GI_125533918 (SEQ ID NO: 170), GI_297728173 (SEQ ID NO: 171), GI_159902513 (SEQ ID NO: 172), GI_225463177 (SEQ ID NO: 173), CeresClone_566899 (SEQ ID NO: 175), GI_294460127 (SEQ ID NO: 176), GI_147856212 (SEQ ID NO: 177), CeresClone_1647753 (SEQ ID NO: 179), GI_115473685 (SEQ ID NO: 180), GI_82697933 (SEQ ID NO: 181), GI_302788858 (SEQ ID NO: 182), GI_168013809 (SEQ ID NO: 183), GI_302788854 (SEQ ID NO: 184), GI_242068025 (SEQ ID NO: 185), GI_302769524 (SEQ ID NO: 186), GI_148270935 (SEQ ID NO: 187), GI:356535621 (SEQ ID NO: 1024), (SEQ ID NO: 1025), GI:225346669 (SEQ ID NO: 1026), GI:326517960 (SEQ ID NO: 1027), (SEQ ID NO: 1028), GI:168011953 (SEQ ID NO: 1029), GI:21618039_CeresClone:42187_CeresClone:9482 (SEQ ID NO: 1031), (SEQ ID NO: 1032), GI:297829024 (SEQ ID NO: 1033), GI:356576751 (SEQ ID NO: 1034), (SEQ ID NO: 1035), GI:125559352 (SEQ ID NO: 1036), GI:357116238 (SEQ ID NO: 1037), GI:326513536 (SEQ ID NO: 1038), GI:225314775 (SEQ ID NO: 1040), GI:359493559 (SEQ ID NO: 1041), GI:225451094 (SEQ ID NO: 1042), CeresAnnot:8657013_GI:242051064 (SEQ ID NO: 1044), (SEQ ID NO: 1045), GI:381218259 (SEQ ID NO: 1046), GI:357441531 (SEQ ID NO: 1047), (SEQ ID NO: 1048), GI:115467742 (SEQ ID NO: 1049), GI:357510077 (SEQ ID NO: 1050), GI:302823479 (SEQ ID NO: 1051), GI:357442625 (SEQ ID NO: 1052), GI:357498883 (SEQ ID NO: 1053), CeresClone:1911189 (SEQ ID NO: 1055), (SEQ ID NO: 1056), GI:356559967 (SEQ ID NO: 1057), (SEQ ID NO: 1058), GI:255574873 (SEQ ID NO: 1059), GI:225460002 (SEQ ID NO: 1060), (SEQ ID NO: 1061), GI:224056763 (SEQ ID NO: 1062), (SEQ ID NO: 1063), GI:297611539 (SEQ ID NO: 1064), CeresClone:1815446 (SEQ ID NO: 1066), GI:82697971 (SEQ ID NO: 1067), GI:255564916 (SEQ ID NO: 1068), (SEQ ID NO: 1069), GI:225459998 (SEQ ID NO: 1070), GI:169159268 (SEQ ID NO: 1071), GI:215261125 (SEQ ID NO: 1072), GI:356500238 (SEQ ID NO: 1073), (SEQ ID NO: 1074), CeresClone:1448852 (SEQ ID NO: 1076), GI:326532822 (SEQ ID NO: 1077), CeresClone:1991076 (SEQ ID NO: 1079), GI:326497909 (SEQ ID NO: 1080), GI:242068027_CeresAnnot:8684742 (SEQ ID NO: 1082), GI:225463175 (SEQ ID NO: 1083), (SEQ ID NO: 1084), GI:357498903 (SEQ ID NO: 1085), GI:125555059 (SEQ ID NO: 1086), GI:357133715_Bradi2g25600 (SEQ ID NO: 1087), CeresClone:892953 (SEQ ID NO: 1089), GI:226498284_CeresClone:330490 (SEQ ID NO: 1091), GI:169159266 (SEQ ID NO: 1092), GI:255564994 (SEQ ID NO: 1093), (SEQ ID NO: 1094), GI:15237783 (SEQ ID NO: 1095), GI:116781798 (SEQ ID NO: 1096), GI:380040722 (SEQ ID NO: 1097), CeresAnnot:1442123 (SEQ ID NO: 1099), GI:356504896 (SEQ ID NO: 1100), GI:356559969 (SEQ ID NO: 1101), (SEQ ID NO: 1102), CeresAnnot:8657010 (SEQ ID NO: 1104), GI:357152486 (SEQ ID NO: 1105), GI:357498895 (SEQ ID NO: 1106), CeresClone:1996207 (SEQ ID NO: 1108), GI:226504948_CeresClone:335133 (SEQ ID NO: 1110), GI:357116047 (SEQ ID NO: 1111), CeresClone:625081 (SEQ ID NO: 1113), (SEQ ID NO: 1114), GI:147820116 (SEQ ID NO: 1115), GI:380040720 (SEQ ID NO: 1116), GI:329756574 (SEQ ID NO: 1117), GI:225316828 (SEQ ID NO: 1119), GI:218185506 (SEQ ID NO: 1120), GI:302769530 (SEQ ID NO: 1121), GI:357152492 (SEQ ID NO: 1122), (SEQ ID NO: 1123), (SEQ ID NO: 1124), GI:168029383 (SEQ ID NO: 1125), GI:125559371 (SEQ ID NO: 1126), GI:357498899 (SEQ ID NO: 1127), GI:357116242 (SEQ ID NO: 1128), GI:380040724 (SEQ ID NO: 1129), (SEQ ID NO: 1130), GI:297812501 (SEQ ID NO: 1131), GI:210144144 (SEQ ID NO: 1133), CeresClone: 568611 (SEQ ID NO: 1135), GI:326527329 (SEQ ID NO: 1136), CeresAnnot:1483390 (SEQ ID NO: 1138), and GI:255553969 (SEQ ID NO: 1139). In some cases, a functional homolog of SEQ ID NO: 99 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 99. In some cases, a functional homolog of SEQ ID NO: 99 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 99 described above or set forth in the Sequence Listing.

Figure 3G:
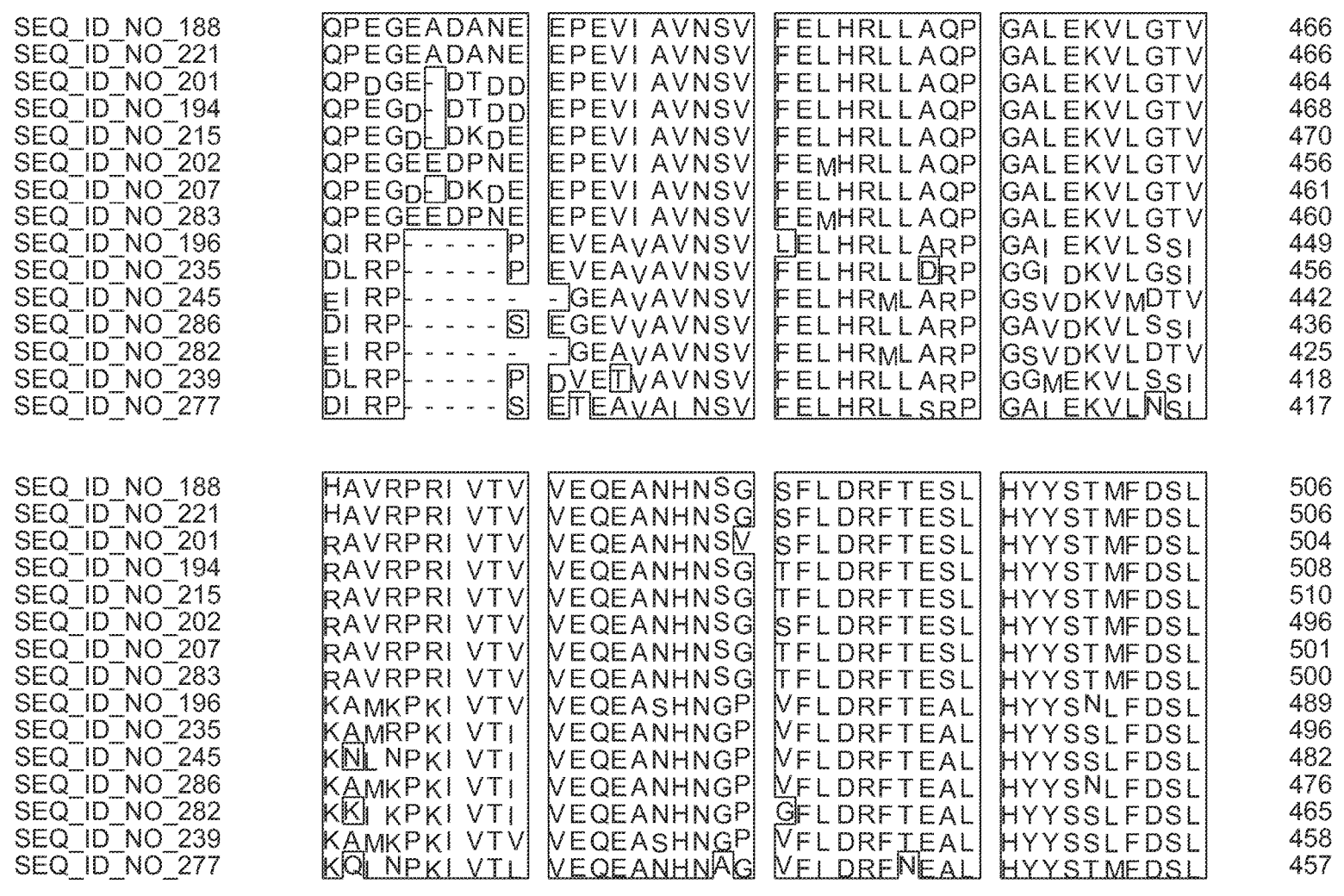

Examples of amino acid sequences of functional homologs of the polypeptide set forth in SEQ ID NO: 188 are provided in FIG. 3 and in the Sequence Listing. Such functional homologs include, for example, GI_2569938 (SEQ ID NO: 189), GI_66816765 (SEQ ID NO: 190), GI_282759334 (SEQ ID NO: 191), CeresClone_1884375 (SEQ ID NO: 193), GI_75207626 (SEQ ID NO: 194), GI_115184057 (SEQ ID NO: 195), GI_225451399 (SEQ ID NO: 196), GI_20257430 (SEQ ID NO: 197), GI_20257459 (SEQ ID NO: 198), GI_20257428 (SEQ ID NO: 199), CeresClone_1776298 (SEQ ID NO: 201), GI_75161835 (SEQ ID NO: 202), GI_204022232 (SEQ ID NO: 203), GI_20257432 (SEQ ID NO: 204), GI_225424291 (SEQ ID NO: 205), GI_20257447 (SEQ ID NO: 206), GI_70797560 (SEQ ID NO: 207), GI_15219630 (SEQ ID NO: 208), GI_225457448 (SEQ ID NO: 209), CeresAnnot_1502385 (SEQ ID NO: 211), CeresClone_1809677 (SEQ ID NO: 213), CeresAnnot_8633163 (SEQ ID NO: 215), GI_302786358 (SEQ ID NO: 216), GI_204022230 (SEQ ID NO: 217), CeresAnnot_1463794 (SEQ ID NO: 219), GI_296804670 (SEQ ID NO: 220), GI_59800349 (SEQ ID NO: 221), GI_75121087 (SEQ ID NO: 222), CeresAnnot_870628 (SEQ ID NO: 224), GI_219964535 (SEQ ID NO: 225), GI_113171199 (SEQ ID NO: 226), CeresClone_1945971 (SEQ ID NO: 228), CeresAnnot_1440830 (SEQ ID NO: 230), GI_238821220 (SEQ ID NO: 231), GI_257219873 (SEQ ID NO: 232), GI_113206404 (SEQ ID NO: 233), CeresAnnot_1445496 (SEQ ID NO: 235), GI_147812753 (SEQ ID NO: 236), CeresAnnot_857982 (SEQ ID NO: 238), GI_255586838 (SEQ ID NO: 239), GI_15237971 (SEQ ID NO: 240), GI_20257436 (SEQ ID NO: 241), GI_225424293 (SEQ ID NO: 242), GI_297844400 (SEQ ID NO: 243), GI_75104298 (SEQ ID NO: 244), GI_148189864 (SEQ ID NO: 245), CeresClone_1884754 (SEQ ID NO: 247), GI_264688602 (SEQ ID NO: 248), GI_219886839 (SEQ ID NO: 249), GI_222154139 (SEQ ID NO: 250), GI_20257420 (SEQ ID NO: 251), GI_119214959 (SEQ ID NO: 252), GI_119214959 (SEQ ID NO: 254), GI_75104297 (SEQ ID NO: 255), GI_66816755 (SEQ ID NO: 256), GI_238821222 (SEQ ID NO: 257), GI_26451075 (SEQ ID NO: 258), GI_152968454 (SEQ ID NO: 259), GI_75121086 (SEQ ID NO: 260), GI_242058173 (SEQ ID NO: 261), GI_225451401 (SEQ ID NO: 262), CeresAnnot_832619 (SEQ ID NO: 264), GI_171702837 (SEQ ID NO: 265), GI_75148243 (SEQ ID NO: 266), GI_20257457 (SEQ ID NO: 267), GI_20257422 (SEQ ID NO: 268), GI_312281569 (SEQ ID NO: 269), GI_125545440 (SEQ ID NO: 270), CeresAnnot_1449379 (SEQ ID NO: 272), GI_290988843 (SEQ ID NO: 273), GI_224032153 (SEQ ID NO: 274), GI_225451515 (SEQ ID NO: 275), GI_339779229 (SEQ ID NO: 276), GI_75146039 (SEQ ID NO: 277), GI_115184074 (SEQ ID NO: 278), GI_321442634 (SEQ ID NO: 279), GI_63054405 (SEQ ID NO: 280), CeresClone_479467 (SEQ ID NO: 282), GI_75207630 (SEQ ID NO: 283), GI_297817754 (SEQ ID NO: 284), GI_2339978 (SEQ ID NO: 285), GI_66816747 (SEQ ID NO: 286), GI:119713908 (SEQ ID NO: 1009), GI:15866400 (SEQ ID NO: 1010), GI:20257442 (SEQ ID NO: 1011), GI:380504012 (SEQ ID NO: 1012), GI:380503998 (SEQ ID NO: 1013), GI:380504056 (SEQ ID NO: 1014), GI:15866316 (SEQ ID NO: 1015), GI:20257440 (SEQ ID NO: 1016), GI:20257463 (SEQ ID NO: 1017), GI:20257451 (SEQ ID NO: 1018), GI:380503968 (SEQ ID NO: 1019), GI:15866328 (SEQ ID NO: 1020), GI:15866334 (SEQ ID NO: 1021), GI:15866348 (SEQ ID NO: 1022), and GI:157154012 (SEQ ID NO: 1023). In some cases, a functional homolog of SEQ ID NO: 188 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 188. In some cases, a functional homolog of SEQ ID NO: 188 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 188 described above or set forth in the Sequence Listing.

Figure 4B:
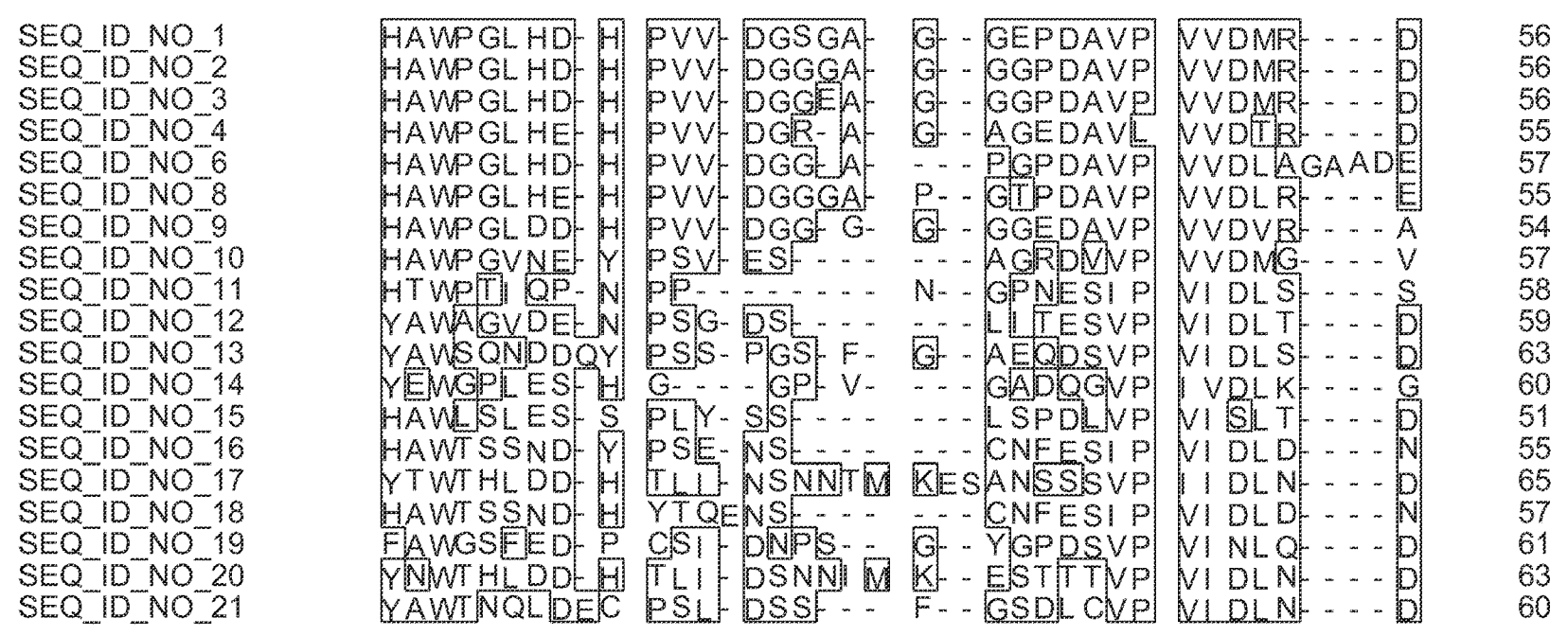
Figure 4G:
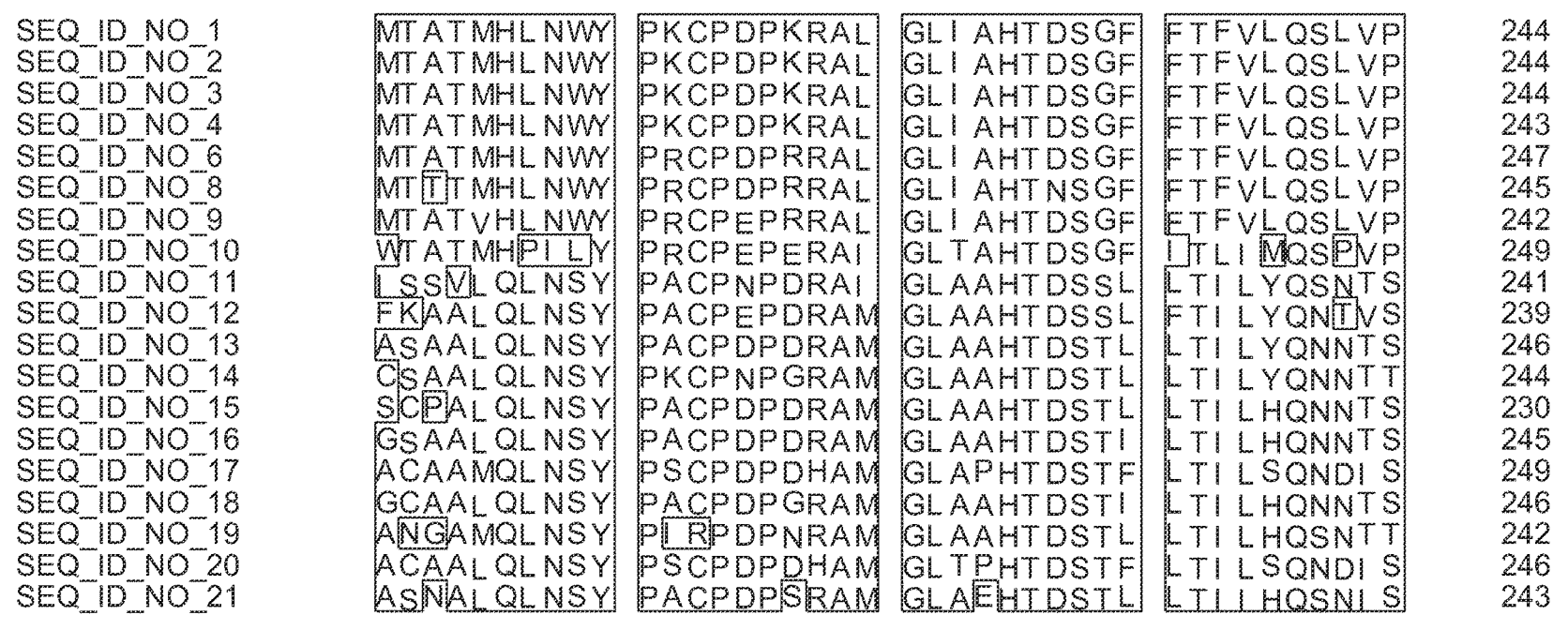
Figure 4J:
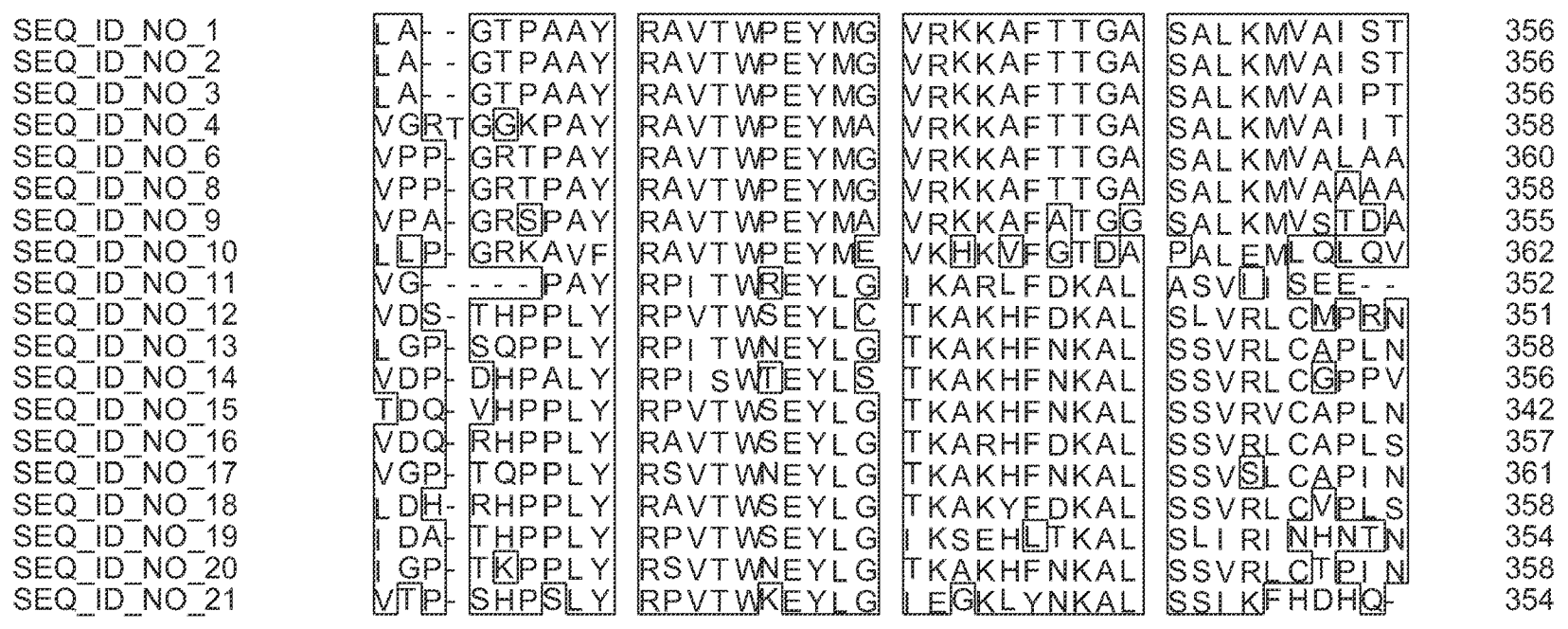

Examples of amino acid sequences of functional homologs of the polypeptide set forth in SEQ ID NO: 1 are provided in FIG. 4 and in the Sequence Listing. Such functional homologs include, for example, GI_49065952 (SEQ ID NO: 2), GI_157683561 (SEQ ID NO: 3), GI_291586147 (SEQ ID NO: 4), CeresAnnot_8658260

(SEQ ID NO: 6), CeresClone_1784588 (SEQ ID NO: 8), GI_15005015 (SEQ ID NO: 9), GI_194700302 (SEQ ID NO: 10), GI_188035730 (SEQ ID NO: 11), GI_147852208 (SEQ ID NO: 12), GI_61651585 (SEQ ID NO: 13), GI_109729785 (SEQ ID NO: 14), GI_190192212 (SEQ ID NO: 15), GI_6691485 (SEQ ID NO: 16), GI_145206857 (SEQ ID NO: 17), GI_225421147 (SEQ ID NO: 18), GI_27261175 (SEQ ID NO: 19), GI_2316018 (SEQ ID NO: 20), GI_77632798 (SEQ ID NO: 21), GI_302811181 (SEQ ID NO: 22), GI_20149245 (SEQ ID NO: 23), GI_15004943 (SEQ ID NO: 24), GI_297849984 (SEQ ID NO: 25), GI_145206861 (SEQ ID NO: 26), GI_225421145 (SEQ ID NO: 27), GI_2289032 (SEQ ID NO: 28), GI_27123661 (SEQ ID NO: 29), GI_49065950 (SEQ ID NO: 30), GI_226508364 (SEQ ID NO: 31), GI_312197436 (SEQ ID NO: 32), GI_218196191 (SEQ ID NO: 33), CeresClone_1045013 (SEQ ID NO: 35), GI_134303282 (SEQ ID NO: 36), GI_14780049 (SEQ ID NO: 37), GI_340796369 (SEQ ID NO: 38), GI_4164147 (SEQ ID NO: 39), GI_9971221 (SEQ ID NO: 40), GI_3982753 (SEQ ID NO: 41), GI_85540947 (SEQ ID NO: 42), CeresAnnot_8725416 (SEQ ID NO: 44), GI_50428333 (SEQ ID NO: 45), GI_50428331 (SEQ ID NO: 46), GI_340796371 (SEQ ID NO: 47), GI_219887767 (SEQ ID NO: 48), GI_15418962 (SEQ ID NO: 49), GI_320462776 (SEQ ID NO: 50), GI_225430186 (SEQ ID NO: 51), GI_2314805 (SEQ ID NO: 52), GI_224070877 (SEQ ID NO: 53), GI_50428329 (SEQ ID NO: 54), GI_297743334 (SEQ ID NO: 55), GI_8247213 (SEQ ID NO: 56), GI_255040357 (SEQ ID NO: 57), GI_297839907 (SEQ ID NO: 58), GI_8894936 (SEQ ID NO: 59), GI_114329242 (SEQ ID NO: 60), GI_304636271 (SEQ ID NO: 61), GI_4164145 (SEQ ID NO: 62), GI_255549086 (SEQ ID NO: 63), GI_224141841 (SEQ ID NO: 64), GI_194459446 (SEQ ID NO: 65), sp_Q39103_G3OX1_ARATH (SEQ ID NO: 66), GI_85540946 (SEQ ID NO: 67), CeresClone_442759 (SEQ ID NO: 69), GI_115462397 (SEQ ID NO: 70), GI_190192214 (SEQ ID NO: 71), GI_304636273 (SEQ ID NO: 72), CeresClone_476411 (SEQ ID NO: 74), GI_2291080 (SEQ ID NO: 75), GI_304636275 (SEQ ID NO: 76), GI_255549006 (SEQ ID NO: 77), CeresClone_1653303 (SEQ ID NO: 79), CeresAnnot_1508682 (SEQ ID NO: 81), GI_294471308 (SEQ ID NO: 82), GI_3834350 (SEQ ID NO: 83), GI_2316102 (SEQ ID NO: 84), GI_11034551 (SEQ ID NO: 85), GI_15418964 (SEQ ID NO: 86), GI_71532877 (SEQ ID NO: 87), GI_40714039 (SEQ ID NO: 88), GI_3834352 (SEQ ID NO: 89), GI_255546615 (SEQ ID NO: 90), GI_38154346 (SEQ ID NO: 91), GI_145206859 (SEQ ID NO: 92), CeresAnnot_1438976 (SEQ ID NO: 94), GI_115434856 (SEQ ID NO: 95), sp_Q9ZT84_G3OX2_ARATH (SEQ ID NO: 96), GI_40714037 (SEQ ID NO: 97), GI_20149243 (SEQ ID NO: 98), CeresClone:1787734 (SEQ ID NO: 978), CeresClone:704370 (SEQ ID NO: 980), GI:357136088 (SEQ ID NO: 981), GI:326502098 (SEQ ID NO: 982), GI:357152716 (SEQ ID NO: 983), GI:242089739 (SEQ ID NO: 984), GI:225442751 (SEQ ID NO: 985), GI:357455059 (SEQ ID NO: 986), GI:365176184 (SEQ ID NO: 987), GI:356522371 (SEQ ID NO: 988), GI:356550578 (SEQ ID NO: 989), GI:357436835 (SEQ ID NO: 990), GI:356563832 (SEQ ID NO: 991), GI:297839909 (SEQ ID NO: 992), GI:356518262 (SEQ ID NO: 993), GI:301332976 (SEQ ID NO: 994), GI:301332946 (SEQ ID NO: 995), GI:301332982 (SEQ ID NO: 996), GI:301332866 (SEQ ID NO: 997), GI:301332872 (SEQ ID NO: 998), GI:356552539 (SEQ ID NO: 999), GI:301332918 (SEQ ID NO: 1000), GI:301332984 (SEQ ID NO: 1001), GI:301332974 (SEQ ID NO: 1002), GI:301332896 (SEQ ID NO: 1003), GI:301332906 (SEQ ID NO: 1004), GI:301333008 (SEQ ID NO: 1005), GI:116831381 (SEQ ID NO: 1006), GI:93007346 (SEQ ID NO: 1007), and GI:255552993 (SEQ ID NO: 1008). In some cases, a functional homolog of SEQ ID NO: 1 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1. In some cases, a functional homolog of SEQ ID NO: 1 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1 described above or set forth in the Sequence Listing.

Figure 5A:
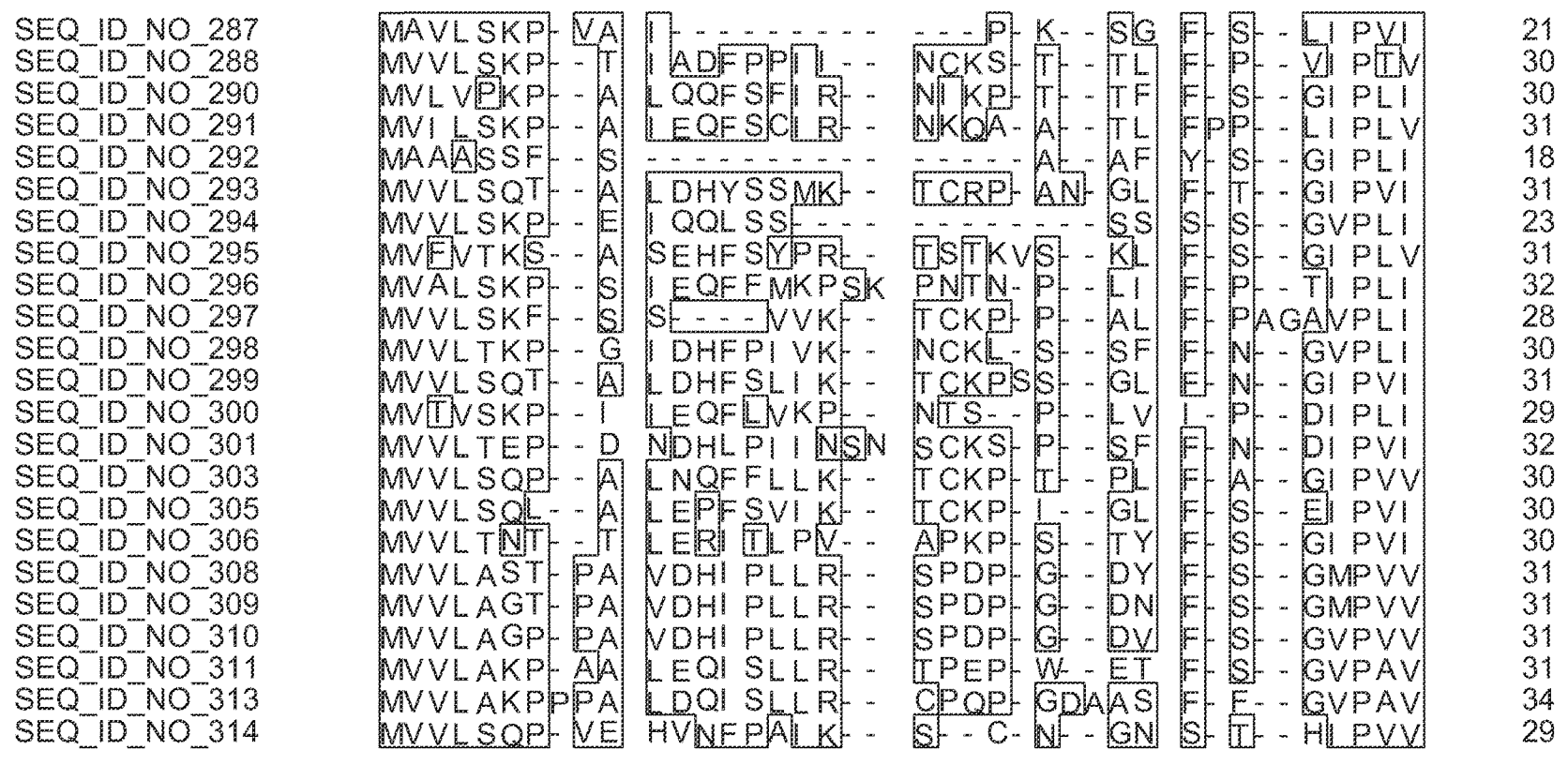
Figure 5D:
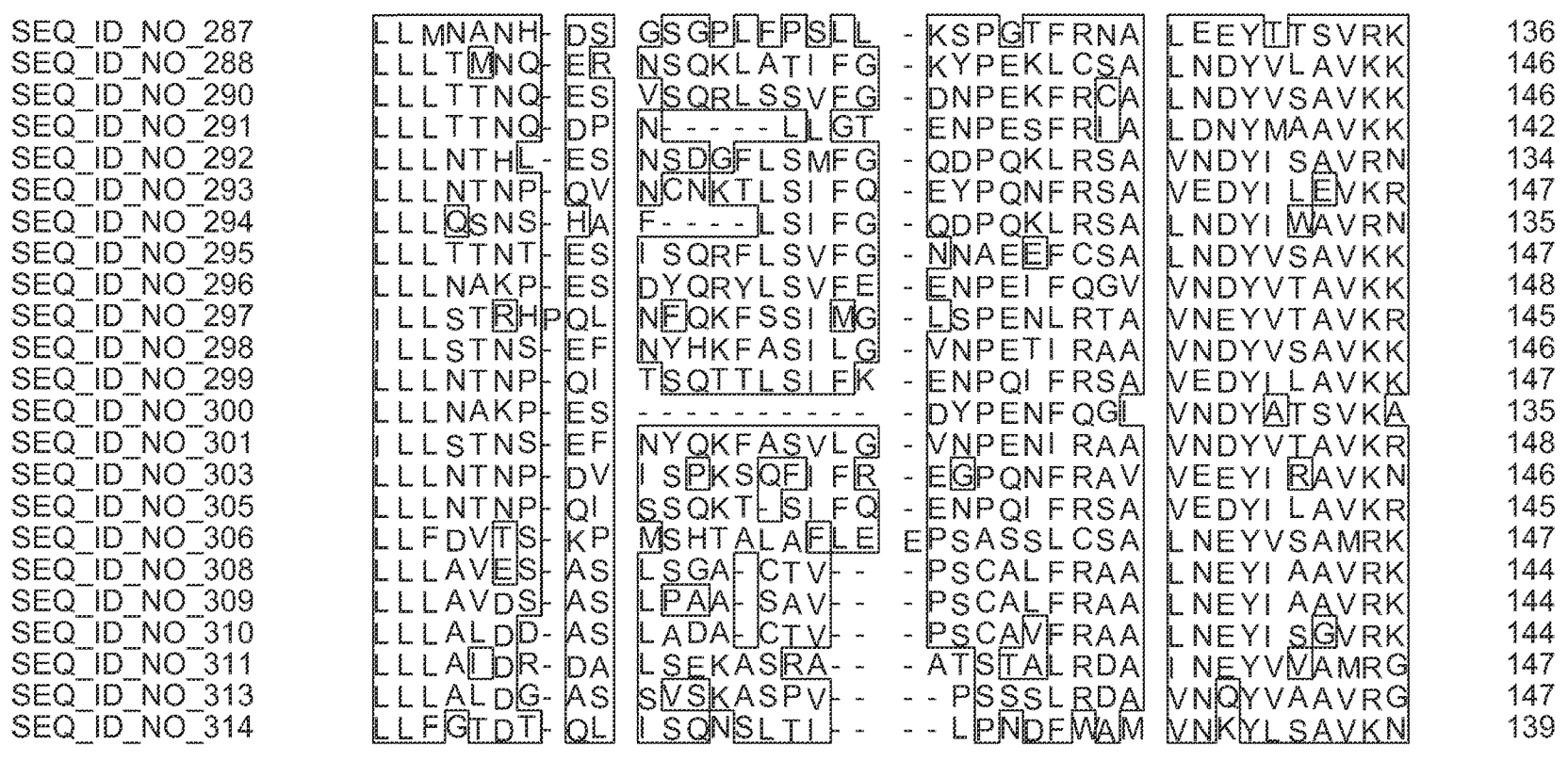

Examples of amino acid sequences of functional homologs of the polypeptide set forth in SEQ ID NO: 287 are provided in FIG. 5 and in the Sequence Listing. Such functional homologs include, for example, GI_147838135 (SEQ ID NO: 288), CeresAnnot_1466321 (SEQ ID NO: 290), GI_340796359 (SEQ ID NO: 291), GI_27123665 (SEQ ID NO: 292), GI_254935149 (SEQ ID NO: 293), GI_1666096 (SEQ ID NO: 294), GI_255040359 (SEQ ID NO: 295), GI_9971227 (SEQ ID NO: 296), GI_305677553 (SEQ ID NO: 297), GI_46849529 (SEQ ID NO: 298), GI_255557309 (SEQ ID NO: 299), GI_213032421 (SEQ ID NO: 300), GI_126843239 (SEQ ID NO: 301), CeresClone_572987 (SEQ ID NO: 303), CeresAnnot_1501920 (SEQ ID NO: 305), GI_192910888 (SEQ ID NO: 306), CeresClone_704889 (SEQ ID NO: 308), GI_326511994 (SEQ ID NO: 309), GI_125527760 (SEQ ID NO: 310), GI_84180617 (SEQ ID NO: 311), CeresAnnot_8733572 (SEQ ID NO: 313), GI_50428335 (SEQ ID NO: 314), GI_46576018 (SEQ ID NO: 315), GI_15221037 (SEQ ID NO: 316), GI_168044732 (SEQ ID NO: 317), CeresAnnot_8734027 (SEQ ID NO: 319), GI_67077820 (SEQ ID NO: 320), GI_67077812 (SEQ ID NO: 321), GI_212721130 (SEQ ID NO: 322), GI_49065954 (SEQ ID NO: 323), GI_320462780 (SEQ ID NO: 324), GI_297847044 (SEQ ID NO: 325), GI_190192216 (SEQ ID NO: 326), CeresAnnot_1497828 (SEQ ID NO: 328), GI_51011366 (SEQ ID NO: 329), GI_9971229 (SEQ ID NO: 330), CeresClone_615793 (SEQ ID NO: 332), GI_119477815 (SEQ ID NO: 333), GI_126843206 (SEQ ID NO: 334), GI_226505220 (SEQ ID NO: 335), GI_49035968 (SEQ ID NO: 336), GI_242057261 (SEQ ID NO: 337), GI_15226777 (SEQ ID NO: 338), GI_147838315 (SEQ ID NO: 339), GI_108755538 (SEQ ID NO: 340), GI_224064641 (SEQ ID NO: 341), GI_152003423 (SEQ ID NO: 342), CeresAnnot_1448918 (SEQ ID NO: 344), CeresClone_909614 (SEQ ID NO: 346), GI_297845928 (SEQ ID NO: 347), GI_225470621 (SEQ ID NO: 348), GI_115462223 (SEQ ID NO: 349), GI_327179117 (SEQ ID NO: 350), GI_15220645 (SEQ ID NO: 351), GI_327179119 (SEQ ID NO: 352), GI_6446413 (SEQ ID NO: 353), GI_297823239 (SEQ ID NO: 354), GI_27261179 (SEQ ID NO: 355), GI_49035760 (SEQ ID NO: 356), GI_297843038 (SEQ ID NO: 357), GI_168063557 (SEQ ID NO: 358), CeresClone_829454 (SEQ ID NO: 360), sp_Q9C6I4_G2OX7_ARATH (SEQ ID NO: 361), GI_125552976 (SEQ ID NO: 362), GI_79318890 (SEQ ID NO: 363), GI_60202574 (SEQ ID NO: 364), GI_67077818 (SEQ ID NO: 365), CeresClone_900331 (SEQ ID NO: 367), GI_222630276 (SEQ ID NO: 368), CeresAnnot_8657905 (SEQ ID NO: 370), GI_126843224 (SEQ ID NO: 371), CeresClone_313261 (SEQ ID NO: 373), GI_32127337 (SEQ ID NO: 374), GI_51011364 (SEQ ID NO: 375), GI_330752217 (SEQ ID NO: 376), sp_O49561_G2OX8_ARATH (SEQ ID NO: 377), GI_251821339 (SEQ ID NO: 378), GI_37544101 (SEQ ID NO: 379), GI_225432055 (SEQ ID NO: 380), CeresClone_1076347 (SEQ ID NO: 382), GI_46849531 (SEQ ID NO: 383), GI_225468310 (SEQ ID NO: 384), CeresAnnot_1441748 (SEQ ID NO: 386), GI_223953574 (SEQ ID NO: 387), GI_49035759 (SEQ ID NO: 388), GI_327179113 (SEQ ID NO: 389), CeresClone_1239118 (SEQ ID NO: 391), GI_125550923 (SEQ ID NO: 392), GI_326520938 (SEQ ID NO: 393), GI_297804032 (SEQ ID NO: 394), GI_27261177 (SEQ ID NO: 395), GI_312196334 (SEQ ID NO: 396), GI_23491590 (SEQ ID NO: 397), GI_168024874 (SEQ ID NO: 398), GI_261863286 (SEQ ID NO: 399), GI_134303284 (SEQ ID NO: 400), CeresClone_1856391 (SEQ ID NO: 402), GI_242054465 (SEQ ID NO: 403), GI_157382968 (SEQ ID NO: 404), GI_15217753 (SEQ ID NO: 405), GI_109729789 (SEQ ID NO: 406), GI_126843214 (SEQ ID NO: 407), GI_327179125 (SEQ ID NO: 408), GI_340796367 (SEQ ID NO: 409), GI_312195240 (SEQ ID NO: 410), CeresAnnot_1511928 (SEQ ID NO: 412), GI_226501026 (SEQ ID NO: 413), GI_224108798 (SEQ ID NO: 414), GI_119475961 (SEQ ID NO: 415), CeresClone_539037 (SEQ ID NO: 417), GI_50293061 (SEQ ID NO: 418), GI_50428337 (SEQ ID NO: 419), GI_225437645 (SEQ ID NO: 420), GI_115440025 (SEQ ID NO: 421), GI_326522773 (SEQ ID NO: 422), GI_218187724 (SEQ ID NO: 423), GI_340796363 (SEQ ID NO: 424), GI_67077816 (SEQ ID NO: 425), CeresClone_156482 (SEQ ID NO: 427), GI_340796365 (SEQ ID NO: 428), GI_242086999 (SEQ ID NO: 429), GI_226501846 (SEQ ID NO: 430), CeresAnnot_1444853 (SEQ ID NO: 432), GI_29825611 (SEQ ID NO: 433), GI_125572075 (SEQ ID NO: 434), GI_297842621 (SEQ ID NO: 435), GI_320462782 (SEQ ID NO: 436), GI_340796361 (SEQ ID NO: 437), GI_225443855 (SEQ ID NO: 438), CeresClone_1860822 (SEQ ID NO: 440), GI_126843218 (SEQ ID NO: 441), CeresClone_1831422 (SEQ ID NO: 443), GI_255548359 (SEQ ID NO: 444), GI_115465423 (SEQ ID NO: 445), GI_255644878 (SEQ ID NO: 446), GI_6478200 (SEQ ID NO: 447), CeresClone_1831239 (SEQ ID NO: 449), CeresClone_1918532 (SEQ ID NO: 451), GI_49065956 (SEQ ID NO: 452), GI_326532306 (SEQ ID NO: 453), GI_327179123 (SEQ ID NO: 454), CeresAnnot_1471538 (SEQ ID NO: 456), GI_284468804 (SEQ ID NO: 457), GI_67077814 (SEQ ID NO: 458), GI_224101511 (SEQ ID NO: 459), GI_87240601 (SEQ ID NO: 460), CeresClone_467671 (SEQ ID NO: 462), GI_134303286 (SEQ ID NO: 463), GI_109729791 (SEQ ID NO: 464), GI_338733586 (SEQ ID NO: 465), GI_125553301 (SEQ ID NO: 466), GI_116672836 (SEQ ID NO: 467), GI_327359295 (SEQ ID NO: 468), GI_297744020 (SEQ ID NO: 469), GI_93115317 (SEQ ID NO: 470), GI:124829 (SEQ ID NO: 1140), GI:7595984 (SEQ ID NO: 1141), GI:356571007 (SEQ ID NO: 1142), GI:357134283 (SEQ ID NO: 1143), GI:356660541 (SEQ ID NO: 1144), GI:218188130 (SEQ ID NO: 1145), GI:356558109 (SEQ ID NO: 1146), GI:365872403 (SEQ ID NO: 1147), GI:379749536 (SEQ ID NO: 1148), GI:6016387 (SEQ ID NO: 1149), GI:66735505 (SEQ ID NO: 1150), GI:356532490 (SEQ ID NO: 1151), GI:356533324 (SEQ ID NO: 1152), CeresClone:1724110 (SEQ ID NO: 1154), GI:171680612 (SEQ ID NO: 1155), GI:358380091 (SEQ ID NO: 1156), GI:357447293 (SEQ ID NO: 1157), GI:125532930 (SEQ ID NO: 1158), GI:357127374 (SEQ ID NO: 1159), GI:126724682 (SEQ ID NO: 1160), GI:53139660 (SEQ ID NO: 1161), GI:225555204 (SEQ ID NO: 1162), GI:14916565 (SEQ ID NO: 1163), GI:380851109 (SEQ ID NO: 1164), GI:222632219 (SEQ ID NO: 1165), GI:357128141 (SEQ ID NO: 1166), GI:356564662 (SEQ ID NO: 1167), GI:3779220 (SEQ ID NO: 1168), GI:113202132 (SEQ ID NO: 1169), GI:50261845 (SEQ ID NO: 1170), GI:356549549 (SEQ ID NO: 1171), GI:169631509 (SEQ ID NO: 1172), GI:114562664 (SEQ ID NO: 1173), GI:116783364 (SEQ ID NO: 1174), GI:116788048 (SEQ ID NO: 1175), GI:125575676 (SEQ ID NO: 1176), GI:225680969 (SEQ ID NO: 1177), CeresAnnot:8668753 (SEQ ID NO: 1179), GI:359473878 (SEQ ID NO: 1180), GI:357488573 (SEQ ID NO: 1181), GI:58269616 (SEQ ID NO: 1182), GI:365848372 (SEQ ID NO: 1183), GI:217385866 (SEQ ID NO: 1184), GI:342868843 (SEQ ID NO: 1185), GI:350637890 (SEQ ID NO: 1186), GI:259487966 (SEQ ID NO: 1187), GI:77360864 (SEQ ID NO: 1188), GI:350285025 (SEQ ID NO: 1189), CeresAnnot:550021 (SEQ ID NO: 1191), GI:126726302 (SEQ ID NO: 1192), GI:377560209 (SEQ ID NO: 1193), GI:356549099 (SEQ ID NO: 1194), GI:125569479 (SEQ ID NO: 1195), GI:145607820 (SEQ ID NO: 1196), GI:344231610 (SEQ ID NO: 1197), GI:224130932 (SEQ ID NO: 1198), GI:322693186 (SEQ ID NO: 1199), GI:37698286 (SEQ ID NO: 1200), CeresAnnot:1517584 (SEQ ID NO: 1202), CeresAnnot:8670458 (SEQ ID NO: 1204), GI:357448799 (SEQ ID NO: 1205), GI:154296822 (SEQ ID NO: 1206), CeresAnnot:1458668 (SEQ ID NO: 1208), GI:357117693 (SEQ ID NO: 1209), GI:1527191 (SEQ ID NO: 1210), GI:115442079 (SEQ ID NO: 1211), CeresAnnot:8725147 (SEQ ID NO: 1213), GI:357136506 (SEQ ID NO: 1214), GI:302759861 (SEQ ID NO: 1215), GI:168058603 (SEQ ID NO: 1216), GI:356510794 (SEQ ID NO: 1217), GI:159149180 (SEQ ID NO: 1218), GI:331700025 (SEQ ID NO: 1219), GI:117586718 (SEQ ID NO: 1220), GI:41323935 (SEQ ID NO: 1221), GI:297830340 (SEQ ID NO: 1222), GI:53792534 (SEQ ID NO: 1223), GI:54260396 (SEQ ID NO: 1224), GI:357128775 (SEQ ID NO: 1225), GI:327179115 (SEQ ID NO: 1226), GI:327306431 (SEQ ID NO: 1227), GI:356499745 (SEQ ID NO: 1228), GI:358368242 (SEQ ID NO: 1229), GI:254583526 (SEQ ID NO: 1230), GI:115435212 (SEQ ID NO: 1231), GI:255557479 (SEQ ID NO: 1232), GI:357476439 (SEQ ID NO: 1233), GI:356555146 (SEQ ID NO: 1234), GI:83033890 (SEQ ID NO: 1235), GI:358348748 (SEQ ID NO: 1236), GI:261251140 (SEQ ID NO: 1237), GI:297829900 (SEQ ID NO: 1238), GI:39950534 (SEQ ID NO: 1239), GI:356503948 (SEQ ID NO: 1240), GI:343794766 (SEQ ID NO: 1241), GI:347758670 (SEQ ID NO: 1242), GI:357488575 (SEQ ID NO: 1243), GI:7108579 (SEQ ID NO: 1244), GI:327348464 (SEQ ID NO: 1245), CeresAnnot:1464270 (SEQ ID NO: 1247), GI:169777699 (SEQ ID NO: 1248), GI:297803592 (SEQ ID NO: 1249), GI:357127376 (SEQ ID NO: 1250), GI:357128527 (SEQ ID NO: 1251), GI:357485645 (SEQ ID NO: 1252), CeresClone:387918 (SEQ ID NO: 1254), GI:363807830 (SEQ ID NO: 1255), GI:317031438 (SEQ ID NO: 1256), GI:326534020 (SEQ ID NO: 1257), GI:146292853 (SEQ ID NO: 1258), GI:343925590 (SEQ ID NO: 1259), GI:123906 (SEQ ID NO: 1260), GI:357129744 (SEQ ID NO: 1261), GI:356556910 (SEQ ID NO: 1262), GI:5579094 (SEQ ID NO: 1263), GI:86197901 (SEQ ID NO: 1264), CeresAnnot:8660515 (SEQ ID NO: 1266), GI:169781970 (SEQ ID NO: 1267), GI:357128523 (SEQ ID NO: 1268), GI:261363611 (SEQ ID NO: 1269), GI:356528126 (SEQ ID NO: 1270), GI:380448148 (SEQ ID NO: 1271), GI:125525840 (SEQ ID NO: 1272), and GI:327179111 (SEQ ID NO: 1273). In some cases, a functional homolog of SEQ ID NO: 287 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 287. In some cases, a functional homolog of SEQ ID NO: 287 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 287 described above or set forth in the Sequence Listing.

Examples of amino acid sequences of functional homologs of the polypeptide set forth in SEQ ID NO: 1429 are provided in FIG. 6 and in the Sequence Listing. Such functional homologs include, for example, GI:342877779 (SEQ ID NO: 1430), GI:197724593 (SEQ ID NO: 1431), GI:115334279 (SEQ ID NO: 1432), GI:310799037 (SEQ ID NO: 1433), GI:302893705 (SEQ ID NO: 1434), GI:85110002 (SEQ ID NO: 1435), GI:169783174 (SEQ ID NO: 1436), GI:242815592 (SEQ ID NO: 1437), GI:336468679 (SEQ ID NO: 1438), GI:255956889 (SEQ ID NO: 1439), GI:346970804 (SEQ ID NO: 1440), GI:315047883 (SEQ ID NO: 1441), GI:239609926 (SEQ ID NO: 1442), GI:310799765 (SEQ ID NO: 1443), GI:322697028 (SEQ ID NO: 1444), GI:351639827 (SEQ ID NO: 1445), GI:310801951 (SEQ ID NO: 1446), GI:317035847 (SEQ ID NO: 1447), GI:317033079 (SEQ ID NO: 1448), GI:39975659 (SEQ ID NO: 1449), GI:312212422 (SEQ ID NO: 1450), GI:145606901 (SEQ ID NO: 1451), GI:336263834 (SEQ ID NO: 1452), GI:350636399 (SEQ ID NO: 1453), GI:119485937 (SEQ ID NO: 1454), GI:46118584 (SEQ ID NO: 1455), GI:116203015 (SEQ ID NO: 1456), GI:351648588 (SEQ ID NO: 1457), GI:327350850 (SEQ ID NO: 1458), GI:134082570 (SEQ ID NO: 1459), GI:238507153 (SEQ ID NO: 1460), GI:350631552 (SEQ ID NO: 1461), GI:261198797 (SEQ ID NO: 1462), GI:351640230 (SEQ ID NO: 1463), GI:342887718 (SEQ ID NO: 1464), GI:115391085 (SEQ ID NO: 1465), GI:255950818 (SEQ ID NO: 1466), GI:67903086 (SEQ ID NO: 1467), GI:346973227 (SEQ ID NO: 1468), GI:310791795 (SEQ ID NO: 1469), GI:46111581 (SEQ ID NO: 1470), GI:302912247 (SEQ ID NO: 1471), GI:302890983 (SEQ ID NO: 1472), GI:325095532 (SEQ ID NO: 1473), GI:310801736 (SEQ ID NO: 1474), GI:169786189 (SEQ ID NO: 1475), GI:322704477 (SEQ ID NO: 1476), GI:296809607 (SEQ ID NO: 1477), GI:358384333 (SEQ ID NO: 1478), GI:380486688 (SEQ ID NO: 1479), GI:380485723 (SEQ ID NO: 1480), GI:380493657 (SEQ ID NO: 1481), GI:310801960 (SEQ ID NO: 1482), GI:380493536 (SEQ ID NO: 1483), GI:380485117 (SEQ ID NO: 1484), GI:367046496 (SEQ ID NO: 1485), GI:358378098 (SEQ ID NO: 1486), GI:328671361 (SEQ ID NO: 1487), GI:328671376 (SEQ ID NO: 1488), GI:328671358 (SEQ ID NO: 1489), GI:328671355 (SEQ ID NO: 1490), GI:342883913 (SEQ ID NO: 1491), GI:328671364 (SEQ ID NO: 1492), GI:27368044 (SEQ ID NO: 1493), GI:242800740 (SEQ ID NO: 1494), GI:15054396 (SEQ ID NO: 1495), GI:351648133 (SEQ ID NO: 1496), GI:28975428 (SEQ ID NO: 1497), GI:380471186 (SEQ ID NO: 1498), GI:270160636 (SEQ ID NO: 1499), GI:326482954 (SEQ ID NO: 1500), GI:115385677 (SEQ ID NO: 1501), GI:351649667 (SEQ ID NO: 1502), GI:358369247 (SEQ ID NO: 1503), GI:39969835 (SEQ ID NO: 1504), GI:327309580 (SEQ ID NO: 1505), GI:169612674 (SEQ ID NO: 1506), GI:269856265 (SEQ ID NO: 1507), GI:269978413 (SEQ ID NO: 1508), GI:270160664 (SEQ ID NO: 1509), GI:346325649 (SEQ ID NO: 1510), GI:134079537 (SEQ ID NO: 1511), GI:46102962 (SEQ ID NO: 1512), GI:270160658 (SEQ ID NO: 1513), GI:270160632 (SEQ ID NO: 1514), GI:270160623 (SEQ ID NO: 1515), GI:145606494 (SEQ ID NO: 1516), GI:358367412 (SEQ ID NO: 1517), GI:270160641 (SEQ ID NO: 1518), GI:270160627 (SEQ ID NO: 1519), GI:358372883 (SEQ ID NO: 1520), GI:339469697 (SEQ ID NO: 1521), GI:270160647 (SEQ ID NO: 1522), GI:380479505 (SEQ ID NO: 1523), GI:169769747 (SEQ ID NO: 1524), GI:212536382 (SEQ ID NO: 1525), GI:310800499 (SEQ ID NO: 1526), GI:310801547 (SEQ ID NO: 1527), GI:115398866 (SEQ ID NO: 1528), GI:146324413 (SEQ ID NO: 1529), GI:159124267 (SEQ ID NO: 1530), GI:317032179 (SEQ ID NO: 1531), GI:121699333 (SEQ ID NO: 1532), GI:134078874 (SEQ ID NO: 1533), GI:242795502 (SEQ ID NO: 1534), GI:71002914 (SEQ ID NO: 1535), GI:380473273 (SEQ ID NO: 1536), GI:255948452 (SEQ ID NO: 1537), GI:302500503 (SEQ ID NO: 1538), GI:121714683 (SEQ ID NO: 1539), GI:23574644 (SEQ ID NO: 1540), and GI:339469460 (SEQ ID NO: 1541). In some cases, a functional homolog of SEQ ID NO: 1429 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1429. In some cases, a functional homolog of SEQ ID NO: 1429 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1429 described above or set forth in the Sequence Listing.

Examples of amino acid sequences of functional homologs of the polypeptide set forth in SEQ ID NO: 1542 are provided in FIG. 7 and in the Sequence Listing. Such functional homologs include, for example, GI:42661490 (SEQ ID NO: 1543), GI:211970313 (SEQ ID NO: 1544), GI:342877776 (SEQ ID NO: 1545), GI:350295800 (SEQ ID NO: 1546), GI:46139765 (SEQ ID NO: 1547), GI:242809430 (SEQ ID NO: 1548), GI:169619475 (SEQ ID NO: 1549), GI:339467588 (SEQ ID NO: 1550), GI:380495415 (SEQ ID NO: 1551), GI:255955071 (SEQ ID NO: 1552), GI:322704192 (SEQ ID NO: 1553), GI:367036275 (SEQ ID NO: 1554), GI:378732306 (SEQ ID NO: 1555), GI:238497964 (SEQ ID NO: 1556), GI:296803841 (SEQ ID NO: 1557), GI:378731760 (SEQ ID NO: 1558), GI:322696305 (SEQ ID NO: 1559), GI:310795092 (SEQ ID NO: 1560), GI:317141690 (SEQ ID NO: 1561), GI:156043835 (SEQ ID NO: 1562), GI:346978982 (SEQ ID NO: 1563), GI:380482210 (SEQ ID NO: 1564), GI:212545757 (SEQ ID NO: 1565), GI:115399682 (SEQ ID NO: 1566), and GI:302417990 (SEQ ID NO: 1567). In some cases, a functional homolog of SEQ ID NO: 1542 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1542. In some cases, a functional homolog of SEQ ID NO: 1542 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1542 described above or set forth in the Sequence Listing.

Examples of amino acid sequences of functional homologs of the polypeptide set forth in SEQ ID NO: 1386 are provided in FIG. 8 and in the Sequence Listing. Such functional homologs include, for example, GI:122938156 (SEQ ID NO: 1387), GI:240282093 (SEQ ID NO: 1388), GI:3549879 (SEQ ID NO: 1389), GI:380486272 (SEQ ID NO: 1390), (SEQ ID NO: 1391), GI:317030883 (SEQ ID NO: 1392), GI:239614263 (SEQ ID NO: 1393), GI:270160669 (SEQ ID NO: 1394), GI:119469260 (SEQ ID NO: 1395), GI:242795506 (SEQ ID NO: 1396), GI:226291700 (SEQ ID NO: 1397), GI:4959945 (SEQ ID NO: 1398), GI:74275563 (SEQ ID NO: 1399), (SEQ ID NO: 1400), GI:159124063 (SEQ ID NO: 1401), GI:367035976 (SEQ ID NO: 1402), GI:159130277 (SEQ ID NO: 1403), GI:67904522 (SEQ ID NO: 1404), (SEQ ID NO: 1405), GI:225679929 (SEQ ID NO: 1406), GI:67902304 (SEQ ID NO: 1407), GI:342877778 (SEQ ID NO: 1408), GI:295667161 (SEQ ID NO: 1409), GI:270160618 (SEQ ID NO: 1410), GI:134076920 (SEQ ID NO: 1411), (SEQ ID NO: 1412), GI:302423784 (SEQ ID NO: 1413), GI:270160651 (SEQ ID NO: 1414), GI:197724589 (SEQ ID NO: 1415), GI:269978406 (SEQ ID NO: 1416), GI:115385431 (SEQ ID NO: 1417), GI:302657172 (SEQ ID NO: 1418), GI:380480560 (SEQ ID NO: 1419), GI:146324548 (SEQ ID NO: 1420), GI:339469066 (SEQ ID NO: 1421), GI:154273751 (SEQ ID NO: 1422), GI:145616804 (SEQ ID NO: 1423), (SEQ ID NO: 1424), GI:328671370 (SEQ ID NO: 1425), GI:350629557 (SEQ ID NO: 1426), GI:261204397 (SEQ ID NO: 1427), and GI:255939330 (SEQ ID NO: 1428). In some cases, a functional homolog of SEQ ID NO: 1386 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1386. In some cases, a functional homolog of SEQ ID NO: 1386 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1386 described above or set forth in the Sequence Listing.

Figure 9A:
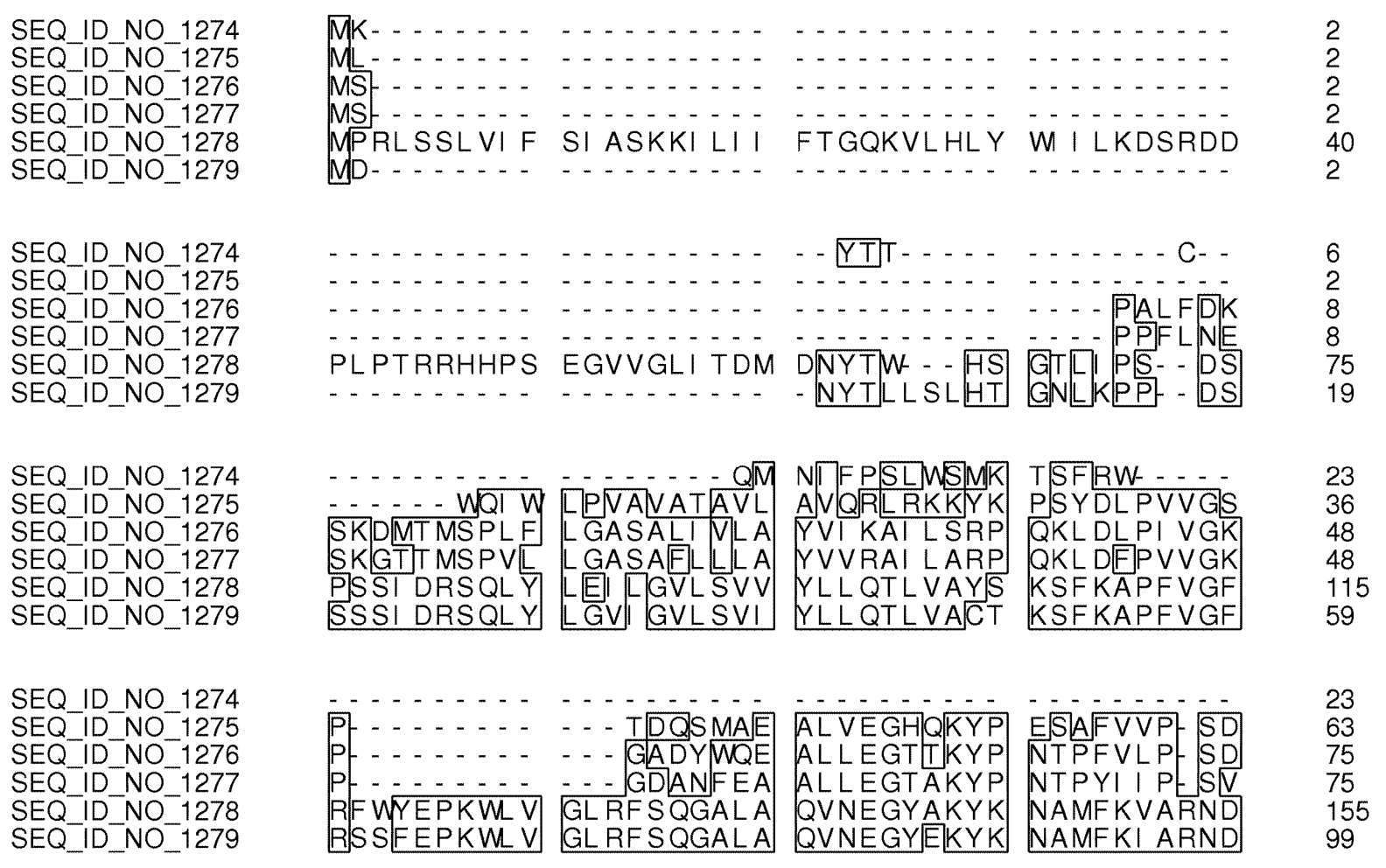
Figure 9C:
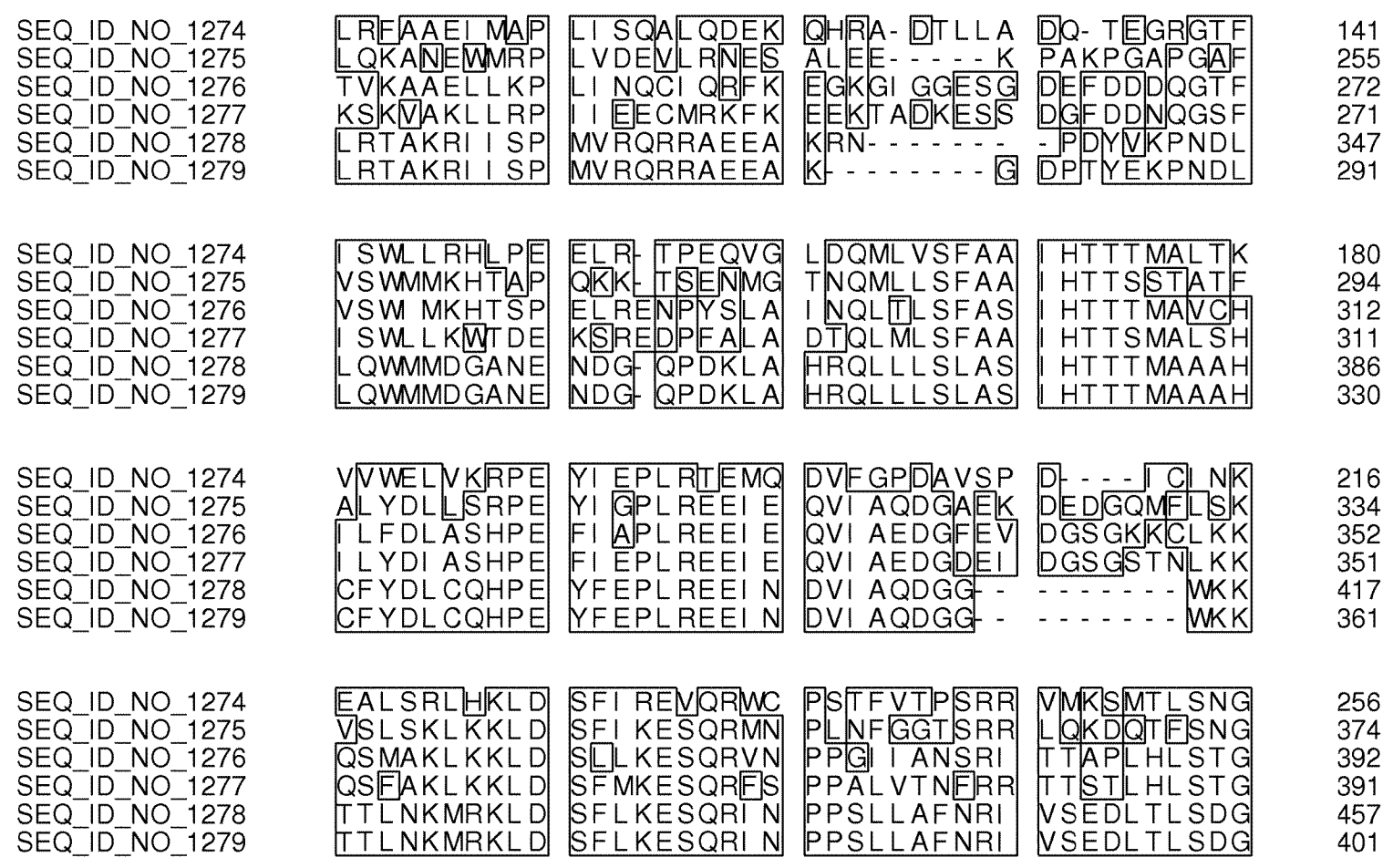

Examples of amino acid sequences of functional homologs of the polypeptide set forth in SEQ ID NO: 1274 are provided in FIG. 9 and in the Sequence Listing. Such functional homologs include, for example, GI:310790427 (SEQ ID NO: 1275), GI:347831214 (SEQ ID NO: 1276), GI:156047892 (SEQ ID NO: 1277), GI:67522282 (SEQ ID NO: 1278), GI:119494789 (SEQ ID NO: 1279), GI:212539424 (SEQ ID NO: 1280), GI:327343381 (SEQ ID NO: 1281), GI:302404826 (SEQ ID NO: 1282), GI:326484980 (SEQ ID NO: 1283), GI:358384361 (SEQ ID NO: 1284), GI:242804557 (SEQ ID NO: 1285), GI:346979790 (SEQ ID NO: 1286), GI:258578343 (SEQ ID NO: 1287), GI:326483893 (SEQ ID NO: 1288), GI:212542733 (SEQ ID NO: 1289), GI:367032834 (SEQ ID NO: 1290), GI:326470143 (SEQ ID NO: 1291), GI:164428375 (SEQ ID NO: 1292), GI:342886866 (SEQ ID NO: 1293), GI:270124461 (SEQ ID NO: 1294), GI:299744611 (SEQ ID NO: 1295), GI:320036821 (SEQ ID NO: 1296), GI:327343267 (SEQ ID NO: 1297), GI:302890139 (SEQ ID NO: 1298), GI:315039401 (SEQ ID NO: 1299), GI:74691493 (SEQ ID NO: 1300), GI:350631590 (SEQ ID NO: 1301), GI:46109972 (SEQ ID NO: 1302), GI:302502806 (SEQ ID NO: 1303), GI:327292707 (SEQ ID NO: 1304), GI:353240577 (SEQ ID NO: 1305), GI:326484981 (SEQ ID NO: 1306), GI:296416849 (SEQ ID NO: 1307), GI:119186083 (SEQ ID NO: 1308), GI:296818735 (SEQ ID NO: 1309), GI:342877777 (SEQ ID NO: 1310), GI:70992027 (SEQ ID NO: 1311), GI:315040165 (SEQ ID NO: 1312), GI:296420744 (SEQ ID NO: 1313), GI:336371322 (SEQ ID NO: 1314), GI:115390288 (SEQ ID NO: 1315), GI:299740695 (SEQ ID NO: 1316), GI:296818393 (SEQ ID NO: 1317), GI:74676162 (SEQ ID NO: 1318), GI:326475322 (SEQ ID NO: 1319), GI:312212946 (SEQ ID NO: 1320), GI:62318475 (SEQ ID NO: 1321), GI:296422933 (SEQ ID NO: 1322), GI:361126544 (SEQ ID NO: 1323), GI:238487930 (SEQ ID NO: 1324), GI:341599458 (SEQ ID NO: 1325), GI:336369617 (SEQ ID NO: 1326), GI:339475687 (SEQ ID NO: 1327), GI:327343373 (SEQ ID NO: 1328), GI:327343325 (SEQ ID NO: 1329), GI:336365283 (SEQ ID NO: 1330), GI:303318042 (SEQ ID NO: 1331), GI:336382397 (SEQ ID NO: 1332), GI:378728369 (SEQ ID NO: 1333), GI:255955605 (SEQ ID NO: 1334), GI:380489258 (SEQ ID NO: 1335), GI:358389174 (SEQ ID NO: 1336), GI:14278967 (SEQ ID NO: 1337), GI:322705205 (SEQ ID NO: 1338), GI:354952198 (SEQ ID NO: 1339), GI:154289961 (SEQ ID NO: 1340), GI:154290109 (SEQ ID NO: 1341), GI:211970315 (SEQ ID NO: 1342), GI:380481111 (SEQ ID NO: 1343), GI:302897901 (SEQ ID NO: 1344), GI:169635726 (SEQ ID NO: 1345), GI:367046821 (SEQ ID NO: 1346), GI:354961647 (SEQ ID NO: 1347), GI:171679136 (SEQ ID NO: 1348), (SEQ ID NO: 1349), GI:145254738 (SEQ ID NO: 1350), GI:327292709 (SEQ ID NO: 1351), GI:170109428 (SEQ ID NO: 1352), GI:340521233 (SEQ ID NO: 1353), GI:302502804 (SEQ ID NO: 1354), GI:350630566 (SEQ ID NO: 1355), GI:320586089 (SEQ ID NO: 1356), GI:326475321 (SEQ ID NO: 1357), GI:380490852 (SEQ ID NO: 1358), GI:330928050 (SEQ ID NO: 1359), GI:302690250 (SEQ ID NO: 1360), GI:350631043 (SEQ ID NO: 1361), GI:255931839 (SEQ ID NO: 1362), GI:336466767 (SEQ ID NO: 1363), GI:328796058 (SEQ ID NO: 1364), GI:296420105 (SEQ ID NO: 1365), GI:302667711 (SEQ ID NO: 1366), GI:351642318 (SEQ ID NO: 1367), GI:119470770 (SEQ ID NO: 1368), GI:340514420 (SEQ ID NO: 1369), GI:56609350 (SEQ ID NO: 1370), GI:367046496 (SEQ ID NO: 1371), GI:121718870 (SEQ ID NO: 1372), GI:240274084 (SEQ ID NO: 1373), GI:154290200 (SEQ ID NO: 1374), GI:302693088 (SEQ ID NO: 1375), GI:296804446 (SEQ ID NO: 1376), GI:302682570 (SEQ ID NO: 1377), GI:156045924 (SEQ ID NO: 1378), GI:336377080 (SEQ ID NO: 1379), GI:336365177 (SEQ ID NO: 1380), GI:156045918 (SEQ ID NO: 1381), GI:116178810 (SEQ ID NO: 1382), GI:169609220 (SEQ ID NO: 1383), GI:347829721 (SEQ ID NO: 1384), and GI:159124430 (SEQ ID NO: 1385). In some cases, a functional homolog of SEQ ID NO: 1274 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1274. In some cases, a functional homolog of SEQ ID NO: 1274 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 1274 described above or set forth in the Sequence Listing.

The identification of conserved regions in a biomass composition-modulating polypeptide facilitates production of variants of biomass composition-modulating polypeptides. Variants of biomass composition-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, FIG. 4, FIG. 5, FIG. 6, FIG. 7, FIG. 8, or FIG. 9, and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at a position marked by dashes, such a polypeptide has a length that is the sum of the amino acid residues in all conserved regions and all dashes.

C. Functional Homologs Identified by HMMER

In some embodiments, useful biomass composition-modulating polypeptides include those that fit a Hidden Markov Model based on the polypeptides set forth in any one of FIGS. 1-9. A Hidden Markov Model (HMM) is a statistical model of a consensus sequence for a group of functional homologs. See, Durbin et al., Biological Sequence Analysis: Probabilistic Models of Proteins and Nucleic Acids, Cambridge University Press, Cambridge, UK (1998). An HMM is generated by the program HMMer 3.0 with default program parameters, using the sequences of the group of functional homologs as input. In some instances, the input files can be in FASTA format. HMMer is provided by the Howard Hughes Medical Institute (hmmenianelia.org).

The multiple sequence alignment is generated by Prob-Cons (Do et al., *Genome Res.*, 15(2):330-40 (2005)) version 1.12 using default parameters: ProbCons is a public domain software program. ProbCons and HMMer can be found on the world wide web at fr.com/probcons/.

The HMM for a group of functional homologs can be used to determine the likelihood that a candidate biomass composition-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMer hmmsearch program. The following parameter is used when running hmmsearch: the E-value cutoff for reporting is set to 1 ("–E1"). A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The biomass composition-modulating polypeptides discussed below fit the indicated HMM with an HMM bit score greater than to 65 (e.g., greater than 70, 80, 90, 100, 120, 140, 200, 300, 500, 1000, 1500, or 2000). In some embodiments, the HMM bit score of a biomass composition-modulating polypeptide discussed below is about 50%, 60%, 70%, 80%, 90%, or 95% of the HMM bit score of a functional homolog provided in the Sequence Listing of this application. In some embodiments, a biomass composition-modulating polypeptide discussed below fits the indicated HMM with an HMM bit score greater than 210, and has a domain indicative of a biomass composition-modulating polypeptide. In some embodiments, a biomass composition-modulating polypeptide discussed below fits the indicated HMM with an HMM bit score greater than 210, and has 65% or greater sequence identity (e.g., 75%, 80%, 85%, 90%, 95%, or 100% sequence identity) to an amino acid sequence shown in any one of FIGS. 1-9.

Examples of polypeptides are shown in the sequence listing that have HMM bit scores greater than 65 (e.g., greater than 70, 75, 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, 620, 640, 660, 680, 700, 710, 720, or 730) when fitted to an HMM generated from the amino acid sequences set forth in FIG. 1 are identified in the Sequence Listing of this application. Such polypeptides include, for example, SEQ ID NOs: 471, 473, 475, 476, 477, 478, 479, 480, 481, 482, 483, 484, 485, 487, 488, 489, 490, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 721, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, and 976.

Examples of polypeptides are shown in the sequence listing that have HMM bit scores greater than 199 (e.g., greater than 200, 210, 220, 230, 240, 250, 260, 270, 280, 290, 300, 320, 340, 260, 380, 400, 420, 440, 460, 480, 500, 520, 540, 560, 580, 600, 620, 640, 660, 680, or 690) when fitted to an HMM generated from the amino acid sequences set forth in FIG. 2 are identified in the Sequence Listing of this application. Such polypeptides include, for example, SEQ ID NOs: 99, 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, and 1139.

Examples of polypeptides are shown in the sequence listing that have HMM bit scores greater than 303 (e.g., greater than 310, 320, 340, 260, 380, 400, 420, 440, 460, 480, 500, 520, 540, 560, 580, 600, 620, 640, 660, 680, 700, 725, 750, 775, 800, 825, 850, 875, 900, 925, 950, 975, 1000, 1025, 1050, 1075, 1100, 1125, 1150, or 1175) when fitted to an HMM generated from the amino acid sequences set forth in FIG. 3 are identified in the Sequence Listing of this application. Such polypeptides include, for example, SEQ ID NOs: 188, 189, 190, 191, 193, 194, 195, 196, 197, 198, 199, 201, 202, 203, 204, 205, 206, 207, 208, 209, 211, 213, 215, 216, 217, 219, 220, 221, 222, 224, 225, 226, 228, 230, 231, 232, 233, 235, 236, 238, 239, 240, 241, 242, 243, 244, 245, 247, 248, 249, 250, 251, 252, 254, 255, 256, 257, 258, 259, 260, 261, 262, 264, 265, 266, 267, 268, 269, 270, 272, 273, 274, 275, 276, 277, 278, 279, 280, 282, 283, 284, 285, 286, 1009, 1010, 1011, 1012, 1013, 1014, 1015, 1016, 1017, 1018, 1019, 1020, 1021, 1022, and 1023.

Examples of polypeptides are shown in the sequence listing that have HMM bit scores greater than 79 (e.g., greater than 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, or 620) when fitted to an HMM generated from the amino acid sequences set forth in FIG. 4 are identified in the Sequence Listing of this application. Such polypeptides include, for example, SEQ ID NOs: 1, 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, and 1008.

Examples of polypeptides are shown in the sequence listing that have HMM bit scores greater than 65 (e.g., greater than 70, 75, 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, 610, or 615) when fitted to an HMM generated from the amino acid sequences set forth in FIG. 5 are identified in the Sequence Listing of this application. Such polypeptides include, for example, SEQ ID NOs: 287, 288, 290, 291, 292, 293, 294, 295, 296, 297, 298, 299, 300, 301, 303, 305, 306, 308, 309, 310, 311, 313, 314, 315, 316, 317, 319, 320, 321, 322, 323, 324, 325, 326, 328, 329, 330, 332, 333, 334, 335, 336, 337, 338, 339, 340, 341, 342, 344, 346, 347, 348, 349, 350, 351, 352, 353, 354, 355, 356, 357, 358, 360, 361, 362, 363, 364, 365, 367, 368, 370, 371, 373, 374, 375, 376, 377, 378, 379, 380, 382, 383, 384, 386, 387, 388, 389, 391, 392, 393, 394, 395, 396, 397, 398, 399, 400, 402, 403, 404, 405, 406, 407, 408, 409, 410, 412, 413, 414, 415, 417, 418, 419, 420, 421, 422, 423, 424, 425, 427, 428, 429, 430, 432, 433, 434, 435, 436, 437, 438, 440, 441, 443, 444, 445, 446, 447, 449, 451, 452, 453, 454, 456, 457, 458, 459, 460, 462, 463, 464, 465, 466, 467, 468, 469, 470, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, and 1273.

Examples of polypeptides are shown in the sequence listing that have HMM bit scores greater than 352 (e.g., greater than 70, 75, 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, 610, or 615) when fitted to an HMM generated from the amino acid sequences set forth in FIG. 6 are identified in the Sequence Listing of this application. Such polypeptides include, for example, SEQ ID NOs: 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, and 1541.

Examples of polypeptides are shown in the sequence listing that have HMM bit scores greater than 57 (e.g., greater than 70, 75, 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, 610, or 615) when fitted to an HMM generated from the amino acid sequences set forth in FIG. 7 are identified in the Sequence Listing of this application. Such polypeptides include, for example, SEQ ID NOs: 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, and 1567.

Examples of polypeptides are shown in the sequence listing that have HMM bit scores greater than 399 (e.g., greater than 70, 75, 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, 610, or 615) when fitted to an HMM generated from the amino acid sequences set forth in FIG. 8 are identified in the Sequence Listing of this application. Such polypeptides include, for example, SEQ ID NOs: 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, and 1428.

Examples of polypeptides are shown in the sequence listing that have HMM bit scores greater than 259 (e.g., greater than 70, 75, 80, 85, 90, 95, 100, 120, 140, 160, 180, 200, 220, 240, 250, 260, 270, 280, 290, 300, 320, 340, 260, 380, 400, 420, 440, 460, 480, 500, 520, 540, 560, 580, 600, 610, or 615) when fitted to an HMM generated from the amino acid sequences set forth in FIG. 9 are identified in the Sequence Listing of this application. Such polypeptides include, for example, SEQ ID NOs: 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, and 1385.

D. Percent Identity

In some embodiments, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 1, 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 99, 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 188, 189, 190, 191, 193, 194, 195, 196, 197, 198, 199, 201, 202, 203, 204, 205, 206, 207, 208, 209, 211, 213, 215, 216, 217, 219, 220, 221, 222, 224, 225, 226, 228, 230, 231, 232, 233, 235, 236, 238, 239, 240, 241, 242, 243, 244, 245, 247, 248, 249, 250, 251, 252, 254, 255, 256, 257, 258, 259, 260, 261, 262, 264, 265, 266, 267, 268, 269, 270, 272, 273, 274, 275, 276, 277, 278, 279, 280, 282, 283, 284, 285, 286, 287, 288, 290, 291, 292, 293, 294, 295, 296, 297, 298, 299, 300, 301, 303, 305, 306, 308, 309, 310, 311, 313, 314, 315, 316, 317, 319, 320, 321, 322, 323, 324, 325, 326, 328, 329, 330, 332, 333, 334, 335, 336, 337, 338, 339, 340, 341, 342, 344, 346, 347, 348, 349, 350, 351, 352, 353, 354, 355, 356, 357, 358, 360, 361, 362, 363, 364, 365, 367, 368, 370, 371, 373, 374, 375, 376, 377, 378, 379, 380, 382, 383, 384, 386, 387, 388, 389, 391, 392, 393, 394, 395, 396, 397, 398, 399, 400, 402, 403, 404, 405, 406, 407, 408, 409, 410, 412, 413, 414, 415, 417, 418, 419, 420, 421, 422, 423, 424, 425, 427, 428, 429, 430, 432, 433, 434, 435, 436, 437, 438, 440, 441, 443, 444, 445, 446, 447, 449, 451, 452, 453, 454, 456, 457, 458, 459, 460, 462, 463, 464, 465, 466, 467, 468, 469, 470, 471, 473, 475, 476, 477, 478, 479, 480, 481, 482, 483, 484, 485, 487, 488, 489, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 721, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, 1139, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, or 1567.

Polypeptides having such a percent sequence identity often have a domain indicative of a biomass composition-modulating polypeptide and/or have an HMM bit score that is greater than 65, as discussed above Amino acid sequences of biomass composition-modulating polypeptides having at least 80% sequence identity to one of the amino acid sequences set forth in SEQ ID NOs: 1, 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 99, 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 188, 189, 190, 191, 193, 194, 195, 196, 197, 198, 199, 201, 202, 203, 204, 205, 206, 207, 208, 209, 211, 213, 215, 216, 217, 219, 220, 221, 222, 224, 225, 226, 228, 230, 231, 232, 233, 235, 236, 238, 239, 240, 241, 242, 243, 244, 245, 247, 248, 249, 250, 251, 252, 254, 255, 256, 257, 258, 259, 260, 261, 262, 264, 265, 266, 267, 268, 269, 270, 272, 273, 274, 275, 276, 277, 278, 279, 280, 282, 283, 284, 285, 286, 287, 288, 290, 291, 292, 293, 294, 295, 296, 297, 298, 299, 300, 301, 303, 305, 306, 308, 309, 310, 311, 313, 314, 315, 316, 317, 319, 320, 321, 322, 323, 324, 325, 326, 328, 329, 330, 332, 333, 334, 335, 336, 337, 338, 339, 340, 341, 342, 344, 346, 347, 348, 349, 350, 351, 352, 353, 354, 355, 356, 357, 358, 360, 361, 362, 363, 364, 365, 367, 368, 370, 371, 373, 374, 375, 376, 377, 378, 379, 380, 382, 383, 384, 386, 387, 388, 389, 391, 392, 393, 394, 395, 396, 397, 398, 399, 400, 402, 403, 404, 405, 406, 407, 408, 409, 410, 412, 413, 414, 415, 417, 418, 419, 420, 421, 422, 423, 424, 425, 427, 428, 429, 430, 432, 433, 434, 435, 436, 437, 438, 440, 441, 443, 444, 445, 446, 447, 449, 451, 452, 453, 454, 456, 457, 458, 459, 460, 462, 463, 464, 465, 466, 467, 468, 469, 470, 471, 473, 475, 476, 477, 478, 479, 480, 481, 482, 483, 484, 485, 487, 488, 489, 490, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 721, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, 1139, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, or 1567 are provided in FIGS. 1-9 and in the Sequence Listing.

"Percent sequence identity" refers to the degree of sequence identity between any given reference sequence, e.g., SEQ ID NO: 1, and a candidate biomass composition-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chema et al., *Nucleic Acids Res.*, 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 471 Amino acid sequences of polypeptides having greater than 45% sequence identity to the polypeptide set forth in SEQ ID NO: 471 are provided in FIG. 1 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 99. Amino acid sequences of polypeptides having greater than 45% sequence identity to the polypeptide set forth in SEQ ID NO: 99 are provided in FIG. 2 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 188 Amino acid sequences of polypeptides having greater than 45% sequence identity to the polypeptide set forth in SEQ ID NO: 188 are provided in FIG. 3 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO 1 Amino acid sequences of polypeptides having greater than 45% sequence identity to the polypeptide set forth in SEQ ID NO: 1 are provided in FIG. 4 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 287 Amino acid sequences of polypeptides having greater than 45% sequence identity to the polypeptide set forth in SEQ ID NO: 287 are provided in FIG. 5 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1429. Amino acid sequences of polypeptides having greater than 45% sequence identity to the polypeptide set forth in SEQ ID NO: 1429 are provided in FIG. 6 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1542. Amino acid sequences of polypeptides having greater than 45% sequence identity to the polypeptide set forth in SEQ ID NO: 1542 are provided in FIG. 7 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1386. Amino acid sequences of polypeptides having greater than 45% sequence identity to the polypeptide set forth in SEQ ID NO: 1386 are provided in FIG. 8 and in the Sequence Listing.

In some cases, a biomass composition-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1274. Amino acid sequences of polypeptides having greater than 45% sequence identity to the polypeptide set forth in SEQ ID NO: 1274 are provided in FIG. 9 and in the Sequence Listing.

E. Other Sequences

It should be appreciated that a biomass composition-modulating polypeptide can include additional amino acids that are not involved in biomass modulation, and thus such a polypeptide can be longer than would otherwise be the case. For example, a biomass composition-modulating polypeptide can include a purification tag, a chloroplast transit peptide, a mitochondrial transit peptide, an amyloplast peptide, or a leader sequence added to the amino or carboxy terminus. In some embodiments, a biomass composition-modulating polypeptide includes an amino acid sequence that functions as a reporter, e.g., a green fluorescent protein or yellow fluorescent protein.

IV. NUCLEIC ACIDS

Nucleic acids described herein include nucleic acids that are effective to modulate biomass composition when transcribed in a plant or plant cell. Such nucleic acids include, without limitation, those that encode a biomass composition-modulating polypeptide and those that can be used to inhibit expression of a biomass composition-modulating polypeptide via a nucleic acid based method.

A. Nucleic Acids Encoding Biomass Composition-Modulating Polypeptides

Nucleic acids encoding biomass composition-modulating polypeptides are described herein. Examples of such nucleic acids include SEQ ID NOs: 5, 7, 34, 43, 68, 73, 78, 80, 93, 100, 102, 109, 118, 122, 125, 130, 147, 149, 153, 165, 168, 174, 178, 192, 200, 210, 212, 214, 218, 223, 227, 229, 234, 237, 246, 253, 263, 271, 281, 289, 302, 304, 307, 312, 318, 327, 331, 343, 345, 359, 366, 369, 372, 381, 385, 390, 401, 411, 416, 426, 431, 439, 442, 448, 450, 455, 461, 472, 474, 486, 494, 497, 507, 516, 543, 557, 560, 565, 581, 591, 596, 598, 603, 611, 616, 642, 662, 687, 694, 704, 722, 753, 755, 766, 771, 774, 786, 798, 811, 819, 840, 848, 903, 977, 979, 1030, 1039, 1043, 1054, 1065, 1075, 1078, 1081, 1088, 1090, 1098, 1103, 1107, 1109, 1112, 1118, 1132, 1134, 1137, 1153, 1178, 1190, 1201, 1203, 1207, 1212, 1246, 1253, and 1265 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 5, 7, 34, 43, 68, 73, 78, 80, 93, 100, 102, 109, 118, 122, 125, 130, 147, 149, 153, 165, 168, 174, 178, 192, 200, 210, 212, 214, 218, 223, 227, 229, 234, 237, 246, 253, 263, 271, 281, 289, 302, 304, 307, 312, 318, 327, 331, 343, 345, 359, 366, 369, 372, 381, 385, 390, 401, 411, 416, 426, 431, 439, 442, 448, 450, 455, 461, 472, 474, 486, 494, 497, 507, 516, 543, 557, 560, 565, 581, 591, 596, 598, 603, 611, 616, 642, 662, 687, 694, 704, 722, 753, 755, 766, 771, 774, 786, 798, 811, 819, 840, 848, 903, 977, 979, 1030, 1039, 1043, 1054, 1065, 1075, 1078, 1081, 1088, 1090, 1098, 1103, 1107, 1109, 1112, 1118, 1132, 1134, 1137, 1153, 1178, 1190, 1201, 1203, 1207, 1212, 1246, 1253, and 1265.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Biomass Composition-Modulating Polypeptide A nucleic acid encoding one of the biomass composition-modulating polypeptides described herein (e.g., a polypeptide set forth in FIG. 1 or a functional homolog thereof, a polypeptide set forth in FIG. 2 or a functional homolog thereof, or a polypeptide set forth in FIG. 4 or a functional homolog thereof, a polypeptide set forth in FIG. 6 or a functional homolog thereof, a polypeptide set forth in FIG. 8 or a functional homolog thereof, or a polypeptide set forth in FIG. 9 or a functional homolog thereof) can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular biomass composition-modulating polypeptide; i.e., for many amino acids, there is more than one nucleotide triplet that serves as the codon for the amino acid. Thus, codons in the coding sequence for a given biomass composition-modulating polypeptide can be modified such that optimal expression in a particular plant species is obtained, using appropriate codon bias tables for that species.

In some cases, expression of a biomass composition-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii Inhibition of Expression of a Biomass Composition-Modulating Polypeptide

Polynucleotides and recombinant constructs described herein can be used to inhibit expression of a biomass composition-modulating polypeptide (e.g. a polypeptide set forth in FIG. 3 or a functional homolog thereof, or a polypeptide set forth FIG. 5 or a functional homolog thereof) in a plant species of interest. See, e.g., Matzke and Birchler, *Nature Reviews Genetics* 6:24-35 (2005); Akashi et al., *Nature Reviews Mol. Cell Biology* 6:413-422 (2005); Mittal, *Nature Reviews Genetics* 5:355-365 (2004); and *Nature Reviews RNA interference collection*, October 2005 on the World Wide Web at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding biomass composition-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a biomass composition-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the biomass composition-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a biomass composition-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the biomass composition-modulating polypeptide. In other embodiments, one strand of the stem portion of a double stranded RNA comprises a sequence that is similar or identical to the sequence of an intron, or a fragment thereof, in the pre-mRNA encoding a biomass composition-modulating polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a biomass composition-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a biomass composition-modulating polypeptide, or a fragment of such sequences. In some embodiments, the sense or antisense sequence is identical or complementary to a sequence of the regulatory region that drives transcription of the gene encoding a biomass composition-modulating polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a biomass composition-modulating polypeptide described herein. The sense sequence complementary to the antisense sequence can be a sequence present within the mRNA of the biomass composition-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences or the left and right border-like sequences of the P-DNA flank, or are on either side of, the nucleic acid. See, e.g., U.S. Patent Publication No. 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, *Antisense Nucleic Acid Drug Dev.*, 7:187-195 (1997); Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate biomass composition. A recombinant nucleic acid construct can comprise a nucleic acid encoding a biomass composition-modulating polypeptide as described herein, operably linked to a regulatory region suitable for expressing the biomass composition-modulating polypeptide in the plant or cell. Thus, in one embodiment a nucleic acid can comprise a coding sequence that encodes a biomass composition-modulating polypeptides as set forth in SEQ ID NOs: 1, 2, 3, 4, 6, 8, 9, 10, 11, 12, 13, 14, 15, 16, 17, 18, 19, 20, 21, 22, 23, 24, 25, 26, 27, 28, 29, 30, 31, 32, 33, 35, 36, 37, 38, 39, 40, 41, 42, 44, 45, 46, 47, 48, 49, 50, 51, 52, 53, 54, 55, 56, 57, 58, 59, 60, 61, 62, 63, 64, 65, 66, 67, 69, 70, 71, 72, 74, 75, 76, 77, 79, 81, 82, 83, 84, 85, 86, 87, 88, 89, 90, 91, 92, 94, 95, 96, 97, 98, 99, 101, 103, 104, 105, 106, 107, 108, 110, 111, 112, 113, 114, 115, 116, 117, 119, 120, 121, 123, 124, 126, 127, 128, 129, 131, 132, 133, 134, 135, 136, 137, 138, 139, 140, 141, 142, 143, 144, 145, 146, 148, 150, 151, 152, 154, 155, 156, 157, 158, 159, 160, 161, 162, 163, 164, 166, 167, 169, 170, 171, 172, 173, 175, 176, 177, 179, 180, 181, 182, 183, 184, 185, 186, 187, 471, 473, 475, 476, 477, 478, 479, 480, 481, 482, 483, 484, 485, 487, 488, 489, 490, 491, 492, 493, 495, 496, 498, 499, 500, 501, 502, 503, 504, 505, 506, 508, 509, 510, 511, 512, 513, 514, 515, 517, 518, 519, 520, 521, 522, 523, 524, 525, 526, 527, 528, 529, 530, 531, 532, 533, 534, 535, 536, 537, 538, 539, 540, 541, 542, 544, 545, 546, 547, 548, 549, 550, 551, 552, 553, 554, 555, 556, 558, 559, 561, 562, 563, 564, 566, 567, 568, 569, 570, 571, 572, 573, 574, 575, 576, 577, 578, 579, 580, 582, 583, 584, 585, 586, 587, 588, 589, 590, 592, 593, 594, 595, 597, 599, 600, 601, 602, 604, 605, 606, 607, 608, 609, 610, 612, 613, 614, 615, 617, 618, 619, 620, 621, 622, 623, 624, 625, 626, 627, 628, 629, 630, 631, 632, 633, 634, 635, 636, 637, 638, 639, 640, 641, 643, 644, 645, 646, 647, 648, 649, 650, 651, 652, 653, 654, 655, 656, 657, 658, 659, 660, 661, 663, 664, 665, 666, 667, 668, 669, 670, 671, 672, 673, 674, 675, 676, 677, 678, 679, 680, 681, 682, 683, 684, 685, 686, 688, 689, 690, 691, 692, 693, 695, 696, 697, 698, 699, 700, 701, 702, 703, 705, 706, 707, 708, 709, 710, 711, 712, 713, 714, 715, 716, 717, 718, 719, 720, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 756, 757, 758, 759, 760, 761, 762, 763, 764, 765, 767, 768, 769, 770, 772, 773, 775, 776, 777, 778, 779, 780, 781, 782, 783, 784, 785, 787, 788, 789, 790, 791, 792, 793, 794, 795, 796, 797, 799, 800, 801, 802, 803, 804, 805, 806, 807, 808, 809, 810, 812, 813, 814, 815, 816, 817, 818, 820, 821, 822, 823, 824, 825, 826, 827, 828, 829, 830, 831, 832, 833, 834, 835, 836, 837, 838, 839, 841, 842, 843, 844, 845, 846, 847, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 978, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1031, 1032, 1033, 1034, 1035, 1036, 1037, 1038, 1040, 1041, 1042, 1044, 1045, 1046, 1047, 1048, 1049, 1050, 1051, 1052, 1053, 1055, 1056, 1057, 1058, 1059, 1060, 1061, 1062, 1063, 1064, 1066, 1067, 1068, 1069, 1070, 1071, 1072, 1073, 1074, 1076, 1077, 1079, 1080, 1082, 1083, 1084, 1085, 1086, 1087, 1089, 1091, 1092, 1093, 1094, 1095, 1096, 1097, 1099, 1100, 1101, 1102, 1104, 1105, 1106, 1108, 1110, 1111, 1113, 1114, 1115, 1116, 1117, 1119, 1120, 1121, 1122, 1123, 1124, 1125, 1126, 1127, 1128, 1129, 1130, 1131, 1133, 1135, 1136, 1138, 1139, 1140, 1141, 1142, 1143, 1144, 1145, 1146, 1147, 1148, 1149, 1150, 1151, 1152, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1179, 1180, 1181, 1182, 1183, 1184, 1185, 1186, 1187, 1188, 1189, 1191, 1192, 1193, 1194, 1195, 1196, 1197, 1198, 1199, 1200, 1202, 1204, 1205, 1206, 1208, 1209, 1210, 1211, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1247, 1248, 1249, 1250, 1251, 1252, 1254, 1255, 1256, 1257, 1258, 1259, 1260, 1261, 1262, 1263, 1264, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, and 1567.

Examples of nucleic acids encoding biomass composition-modulating polypeptides are set forth in SEQ ID NOs: 5, 7, 34, 43, 68, 73, 78, 80, 93, 100, 102, 109, 118, 122, 125, 130, 147, 149, 153, 165, 168, 174, 178, 192, 200, 210, 212, 214, 218, 223, 227, 229, 234, 237, 246, 253, 263, 271, 281, 289, 302, 304, 307, 312, 318, 327, 331, 343, 345, 359, 366, 369, 372, 381, 385, 390, 401, 411, 416, 426, 431, 439, 442, 448, 450, 455, 461, 472, 474, 486, 494, 497, 507, 516, 543, 557, 560, 565, 581, 591, 596, 598, 603, 611, 616, 642, 662, 687, 694, 704, 722, 753, 755, 766, 771, 774, 786, 798, 811, 819, 840, 848, 903, 977, 979, 1030, 1039, 1043, 1054, 1065, 1075, 1078, 1081, 1088, 1090, 1098, 1103, 1107, 1109, 1112, 1118, 1132, 1134, 1137, 1153, 1178, 1190, 1201, 1203, 1207, 1212, 1246, 1253, and 1265, or in the Sequence Listing. The biomass composition-modulating polypeptide encoded by a recombinant nucleic acid can be a native biomass composition-modulating polypeptide, or can be heterologous to the cell. In some cases, the recombinant construct contains a nucleic acid that inhibits expression of a biomass composition-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen® (Madison, Wis.), Clontech® (Palo Alto, Calif.), Stratagene® (La Jolla, Calif.), and Invitrogen/Life Technologies® (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; Ser. Nos. 10/957,569; 11/058,689; 11/172,703; 11/208,308; 11/274,890; 60/583,609; 60/612,891; Ser. Nos. 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; PCT/US07/62762; PCT/US2009/032485; and PCT/US2009/038792.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Colliding et al., *Plant Physiol.*, 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmycl (see, Urao, *Plant Mol. Biol.*, 32:571-57 (1996); Conceicao, *Plant*, 5:493-505 (1994)); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan, *Genetics*, 142:1009-1020 (1996)); maize Cat3 (see, GenBank No. L05934; Abler, *Plant Mol. Biol.*, 22:10131-1038 (1993)). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* 20:647-654 (2001)), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

ix. Inducible Promoters

Inducible promoters confer transcription in response to external stimuli such as chemical agents or environmental stimuli. For example, inducible promoters can confer transcription in response to hormones such as gibberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and promoters used with CryIA(b) and CryIA(c) (Braga et al. 2003, *Journal of New Seeds* 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. In some embodiments, a promoter may preferentially drive expression in reproductive tissues (e.g., PO2916 promoter, SEQ ID NO:31 in 61/364,903). Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a biomass composition-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

V. SEQUENCES OF INTEREST

Plants and cells described herein can also have a second exogenous nucleic acid that comprises a sequence of interest, which is preselected for its beneficial effect upon a trait of commercial value. An exogenous nucleic acid comprising a sequence of interest is operably linked to a regulatory region for transformation into plants, and plants are selected whose expression of the sequence of interest achieves a desired amount and/or specificity of expression. A suitable regulatory region is chosen as described herein. In most cases, expression of a sequence of interest is regulated independently of biomass composition-modulating sequences in plants. It will be appreciated, however, that in some embodiments expression of a sequence of interest is regulated by transcription factors that regulate biomass composition-modulating sequences as described herein.

A sequence of interest can encode a polypeptide or can regulate the expression of a polypeptide. A sequence of interest that encodes a polypeptide can encode a plant polypeptide, a non-plant polypeptide such as a mammalian polypeptide, a modified polypeptide, a synthetic polypeptide, or a portion of a polypeptide. In some embodiments, a sequence of interest is transcribed into an antisense or interfering RNA molecule.

More than one sequence of interest can be present in a plant, e.g., two, three, four, five, six, seven, eight, nine, or ten sequences of interest can be present in a plant. Each sequence of interest can be present on the same nucleic acid construct or can be present on separate nucleic acid constructs. The regulatory region operably linked to each sequence of interest can be the same or can be different.

Sequences of interest that can be used in the methods described herein include, but are not limited to, sequences encoding genes or fragments thereof that modulate cold tolerance, frost tolerance, heat tolerance, drought tolerance, water used efficiency, nitrogen use efficiency, pest resistance, biomass, chemical composition, plant architecture, and/or biofuel conversion properties. In particular, exemplary sequences are described in the following applications which are incorporated herein by reference in their entirety: US20080131581, US20080072340, US20070277269, US20070214517, US 20070192907, US 20070174936, US 20070101460, US 20070094750, US20070083953, US 20070061914, US20070039067, US20070006346, US20070006345, US20060294622, US20060195943, US20060168696, US20060150285, US20060143729, US20060134786, US20060112454, US20060057724, US20060010518, US20050229270, US20050223434, US20030217388, WO 2011/011412, WO 2010/033564, and WO2009/102965.

VI. TRANSGENIC PLANTS AND PLANT CELLS

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous biomass composition-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a biomass composition-modulating polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of biomass. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a biomass composition relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita,*

*Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis*, and *Zea*.

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), Triticosecale (triticum—wheat×rye) and bamboo.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava)

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii*, and *Tanacetum parthenium*.

Suitable species also include *Parthenium argentatum* (guayule), *Hevea* spp. (rubber), *Mentha spicata* (mint), *Mentha piperita* (mint), *Bixa orellana*, and *Alstroemeria* spp.

Suitable species also include *Rosa* spp. (rose), *Dianthus caryophyllus* (carnation), *Petunia* spp. (petunia) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

In some embodiments, a suitable species can be a wild, weedy, or cultivated *Pennisetum* species such as, but not limited to, *Pennisetum alopecuroides, Pennisetum arnhemicum, Pennisetum caffrum, Pennisetum clandestinum, Pennisetum divisum, Pennisetum glaucum, Pennisetum latifolium, Pennisetum macrostachyum, Pennisetum macrourum, Pennisetum orientale, Pennisetum pedicellatum, Pennisetum polystachion, Pennisetum polystachion* ssp. *Setosum, Pennisetum purpureum, Pennisetum setaceum, Pennisetum subangustum, Pennisetum typhoides, Pennisetum villosum*, or hybrids thereof (e.g., *Pennisetum purpureum×Pennisetum typhoidum*).

In some embodiments, a suitable species can be a wild, weedy, or cultivated *Miscanthus* species and/or variety such as, but not limited to, *Miscanthus×giganteus, Miscanthus sinensis, Miscanthus×ogiformis, Miscanthus floridulus, Miscanthus transmorrisonensis, Miscanthus oligostachyus, Miscanthus nepalensis, Miscanthus sacchariflorus, Miscanthus×giganteus* 'Amuri', *Miscanthus×giganteus* 'Nagara', *Miscanthus×giganteus* 'Illinois', *Miscanthus sinensis* var. 'Goliath', *Miscanthus sinensis* var. 'Roland', *Miscanthus sinensis* var. 'Africa', *Miscanthus sinensis* var. 'Fern Osten', *Miscanthus sinensis* var. *gracillimus*, *Miscanthus sinensis* var. *variegates*, *Miscanthus sinensis* var. *purpurascens*, *Miscanthus sinensis* var. 'Malepartus', *Miscanthus sacchariflorus* var. 'Robusta', *Miscanthus sinensis* var. 'Silberfedher' (aka. Silver Feather), *Miscanthus transmorrisonensis, Miscanthus condensatus, Miscanthus yakushimanum, Miscanthus* var. 'Alexander', *Miscanthus* var. 'Adagio', *Miscanthus* var. 'Autumn Light', *Miscanthus* var. 'Cabaret', *Miscanthus* var. 'Condensatus', *Miscanthus* var. 'Cosmopolitan', *Miscanthus* var. 'Dixieland', *Miscanthus* var. 'Gilded Tower' (U.S. Pat. No. PP14,743), *Miscanthus* var. 'Gold Bar' (U.S. Pat. No. PP15,193), *Miscanthus* var. 'Gracillimus', *Miscanthus* var. 'Graziella', *Miscanthus* var. 'Grosse Fontaine', *Miscanthus* var. 'Hinjo aka Little Nicky'™, *Miscanthus* var. 'Juli', *Miscanthus* var. 'Kaskade', *Miscanthus* var. 'Kirk Alexander', *Miscanthus* var. 'Kleine Fontaine', *Miscanthus* var. 'Kleine Silberspinne' (aka. 'Little Silver Spider'), *Miscanthus* var. 'Little Kitten', *Miscanthus* var. 'Little Zebra' (U.S. Pat. No. PP13,008), *Miscanthus* var. 'Lottum', *Miscanthus* var. 'Malepartus', *Miscanthus* var. 'Morning Light', *Miscanthus* var. 'Mysterious Maiden' (U.S. Pat. No. PP16, 176), *Miscanthus* var. 'Nippon', *Miscanthus* var. 'November Sunset', *Miscanthus* var. 'Parachute', *Miscanthus* var. 'Positano', *Miscanthus* var. 'Puenktchen'(aka 'Little Dot'), *Miscanthus* var. 'Rigoletto', *Miscanthus* var. 'Sarabande', *Miscanthus* var. 'Silberpfeil' (aka. Silver Arrow), *Miscanthus* var. 'Silverstripe', *Miscanthus* var. 'Super Stripe' (U.S. Pat. No. PP18,161), *Miscanthus* var. 'Strictus', or *Miscanthus* var. 'Zebrinus'.

In some embodiments, a suitable species can be a wild, weedy, or cultivated *sorghum* species and/or variety such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum*

*virgatum*, *Sorghum vulgare*, or hybrids such as *Sorghum× almum*, *Sorghum×sudangrass* or *Sorghum×drummondii*.

Thus, the methods and compositions can be used over a broad range of plant species, including species from the dicot genera *Brassica*, *Carthamus*, *Glycine*, *Gossypium*, *Helianthus*, *Jatropha*, *Parthenium*, *Populus*, and *Ricinus*; and the monocot genera *Elaeis*, *Festuca*, *Hordeum*, *Lolium*, *Oryza*, *Panicum*, *Pennisetum*, *Phleum*, *Poa*, *Saccharum*, *Secale*, *Sorghum*, *Triticosecale*, *Triticum*, and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp.× *Miscanthus* sp., *Sorghum* sp.×*Miscanthus* sp., e.g., *Panicum virgatum×Panicum amarum*, *Panicum virgatum×Panicum amarulum*, and *Pennisetum purpureum×Pennisetum typhoidum*).

D. Transgenic Plant Phenotypes

In some embodiments, a plant in which expression of a biomass composition-modulating polypeptide is modulated has increased or decreased levels of sugar, ash, or glucan content. A plant in which expression of a biomass composition-modulating polypeptide is modulated also can have increased or decreased conversion efficiency. A component of biomass composition can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level of the biomass component in a corresponding control plant that does not express the transgene. In some embodiments, a plant in which expression of a biomass composition-modulating polypeptide is modulated can have decreased levels of a biomass component. The level can be decreased by at least 2 percent, e.g., 2, 3, 4, 5, 10, 15, 20, 25, 30, 35, or more than 35 percent, as compared to the level in a corresponding control plant that does not express the transgene.

Increases in a component of biomass composition (e.g., total sugar content) in such plants can provide improved nutritional availability in geographic locales where intake of plant foods is often insufficient, or for energy production (e.g., conversion efficiency). In some embodiments, decreases in a component of biomass composition in such plants can be useful in energy production.

In some embodiments, a plant in which expression of a biomass composition-modulating polypeptide is modulated can have increased or decreased levels of a biomass component (e.g., sugar content) in one or more plant tissues, e.g., vegetative tissues, reproductive tissues, or root tissues. For example, the level of a biomass component can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level in a corresponding control plant that does not express the transgene. In some embodiments, a plant in which expression of a biomass composition-modulating polypeptide is modulated can have decreased levels of a biomass component in one or more plant tissues. The level can be decreased by at least 2 percent, e.g., 2, 3, 4, 5, 10, 15, 20, 25, 30, 35, or more than 35 percent, as compared to the level in a corresponding control plant that does not express the transgene.

Typically, a difference in the amount of a biomass component in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the amount of a biomass component is statistically significant at $p<0.01$, $p<0.005$, or $p<0.001$. A statistically significant difference in, for example, the amount of a biomass component in a transgenic plant compared to the amount of a control plant indicates that the recombinant nucleic acid present in the transgenic plant results in altered biomass composition.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

Biomass can include harvestable plant tissues such as leaves, stems, and reproductive structures, or all plant tissues such as leaves, stems, roots, and reproductive structures. In some embodiments, biomass encompasses only above ground plant parts. In some embodiments, biomass encompasses only stem plant parts. In some embodiments, biomass encompasses only above ground plant parts except inflorescence and seed parts of a plant. Biomass can be measured as described in the examples section. Biomass can be quantified as dry matter yield, which is the mass of biomass produced (usually reported in T/acre) if the contribution of water is subtracted from the fresh mater weight. Dry matter yield (DMY) yield is calculated using the fresh matter weight (FMW) and a measurement of weight percent moisture (M) in the following equation. $DMY=((100-M)/100)*FMW$. Biomass can be quantified as fresh matter yield, which is the mass of biomass produced (usually reported in T/acre) on an as-received basis, which includes the weight of moisture.

VII. MODIFYING ENDOGENOUS NUCLEIC ACIDS ENCODING BIOMASS COMPOSITION-MODULATING POLYPEPTIDES

This document also features plant cells and plants in which an endogenous biomass composition-modulating nucleic acid described herein has been modified (e.g., a regulatory region, intron, or coding region of the biomass composition-modulating nucleic acid has been modified). The biomass composition of such plants is altered relative to the corresponding composition of a control plant in which the endogenous nucleic acid is not modified. Such plants are referred to herein as modified plants and may be used to produce, for example, increased amounts of a biomass component (e.g., total sugar content).

Endogenous nucleic acid can be modified by homologous recombination techniques. For example, sequence specific endonucleases (e.g., zinc finger nucleases (ZFNs)) and meganucleases can be used to stimulate homologous recombination at endogenous plant genes. See, e.g., Townsend et al., *Nature* 459:442-445 (2009); Tovkach et al., *Plant J.*, 57:747-757 (2009); and Lloyd et al., *Proc. Natl. Acad. Sci. USA*, 102:2232-2237 (2005). In particular, ZFNs engineered to create DNA double strand breaks at specific loci can be used to make targeted sequence changes in endogenous plant genes. For example, an endogenous plant gene can be replaced with a variant containing one or more mutations (e.g., produced using site-directed mutagenesis or directed evolution). In some embodiments, site directed mutagenesis is achieved via non-homologous end joining such that after breaking DNA, endogenous DNA repair mechanisms ligate the break, often introducing slight deletions or additions that can be screened at the cell or plant level for desired phenotypes. Moore and Haber, *Mol Cell Biol.*, 16(5):2164-73 (1996).

In some embodiments, endogenous nucleic acids can be modified by methylation or demethylation such that the expression of the modified endogenous nucleic acid is altered. For example, a double stranded RNA can be used to activate gene expression by targeting noncoding regulatory regions in gene promoters. See Shibuya et al., *Proc Natl Acad Sci USA*, 106(5): 1660-1665 (2009); and Li et al., *Proc Natl Acad Sci USA*, 103(46):17337-42 (2006). In some embodiments, ZFNs engineered to create DNA double strand breaks at specific loci can be used to insert a DNA fragment having at least one region that overlaps with the endogenous DNA to facilitate homologous recombination, such that the non-overlapping portion of the DNA fragment is integrated at the break site. For example, a fragment can be inserted into an endogenous promoter and/or regulatory region at a specific site where a ZFN created a double stranded break to alter the expression of an endogenous gene. For example, a fragment that is inserted into an endogenous gene coding region at a specific site where a ZFN created a double stranded break can result in expression of a chimeric gene. For example, a fragment that functions as a regulatory region or promoter that is inserted into an endogenous DNA region immediately upstream of a gene coding sequence at a specific site where a ZFN creates a double strand break can result in altered expression of the endogenous gene.

In some embodiments, endogenous nucleic acids can be modified using activation tagging. For example, a vector containing multiple copies of an enhancer element from the constitutively active promoter of the cauliflower mosaic virus (CaMV) 35S gene can be used to activate an endogenous gene. See, Weigel et al., *Plant Physiology*, 122:1003-1013 (2000).

In some embodiments, endogenous nucleic acids can be modified by introducing an engineered transcription activation/repression factor (e.g., zinc finger protein transcription factor, or ZFP TF. See, for example, the world wide web at sangamo.com/tech/tech_plat_over.html#whatarezfp). For example, a synthetic transcription facto sequence of a zinc finger DNA binding domain and a VP16 activation domain can be designed to bind to a specific endogenous DNA site and alter expression of an endogenous gene. An engineered transcription activation/repression factor (such as ZFP TF) can activate, repress, or switch the target endogenous biomass, sucrose, and/or conversion-gene expression by binding specifically to the promoter region or coding region of the endogenous gene. Engineered nucleases that cleave specific DNA sequences in vivo can also be valuable reagents for targeted mutagenesis. One such class of sequence-specific nucleases can be created by fusing transcription activator-like effectors (TALEs) to the catalytic domain of the FoId endonuclease. Both native and custom TALE-nuclease fusions direct DNA double-strand breaks to specific, targeted sites. Christian, et al., *Genetics* 186: 757-761 (2010).

In some embodiments, endogenous nucleic acids can be modified by mutagenesis. Genetic mutations can be introduced within regenerable plant tissue using one or more mutagenic agents. Suitable mutagenic agents include, for example, ethyl methane sulfonate (EMS), N-nitroso-N-ethylurea (ENU), methyl N-nitrosoguanidine (MNNG), ethidium bromide, diepoxybutane, ionizing radiation, x-rays, UV rays and other mutagens known in the art. Suitable types of mutations include, for example, insertions or deletions of nucleotides, and transitions or transversions in the endogenous nucleic acid sequence. In one embodiment, TILLING (Targeted Induced Local Lesions In Genomes) can be used to produce plants having a modified endogenous nucleic acid. TILLING combines high-density mutagenesis with high-throughput screening methods. See, for example, McCallum et al., *Nat Biotechnol* 18: 455-457 (2000); reviewed by Stemple, *Nat Rev Genet* 5(2):145-50 (2004).

In some embodiments, an endogenous nucleic acid can be modified via a gene silencing technique. See, for example, the section herein regarding "Inhibition of Expression of a Biomass composition-modulating Polypeptide."

A population of plants can be screened and/or selected for those members of the population that have a modified nucleic acid. A population of plants also can be screened and/or selected for those members of the population that have a trait or phenotype conferred by expression of the modified nucleic acid. As an alternative, a population of plants can be screened for those plants having a desired trait, such as a modulated level of biomass. For example, a population of progeny can be screened for those plants having a desired level of expression of a biomass composition-modulating polypeptide or nucleic acid. Physical and biochemical methods can be used to identify modified nucleic acids and/or expression levels as described with transgenic plants. Selection and/or screening can be carried out over one or more generations, and/or in more than one geographic location. In some cases, plants can be grown and selected under conditions which induce a desired phenotype or are otherwise necessary to produce a desired phenotype in a modified plant. In addition, selection and/or screening can be applied during a particular developmental stage in which the phenotype is expected to be exhibited by the plant. Selection and/or screening can be carried out to choose those modified plants having a statistically significant difference in biomass composition relative to a control plant in which the nucleic acid has not been modified. Selected or screened modified plants have an altered phenotype as compared to a corresponding control plant, as described in the "Transgenic Plant Phenotypes" section herein.

Although a plant or plant cell in which an endogenous biomass composition-modulating nucleic acid has been modified is not transgenic for that particular nucleic acid, it will be appreciated that such a plant or cell may contain transgenes. For example, a modified plant can contain a transgene for other traits, such as herbicide tolerance or insect resistance. As another example, a modified plant can contain one or more transgenes that, in conjunction with modifications of one or more endogenous nucleic acids, exhibits an increase in a component of biomass.

As with transgenic plant cells, modified plant cells can constitute part or all of a whole plant. Such plants can be grown in the same manner as described for transgenic plants and can be bred or propagated in the same manner as described for transgenic plants.

VIII. PLANT BREEDING

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBR® Green), or a fluorophore-containing DNA probe, such as single-stranded oligonucleotides covalently bound to a fluorescent reporter or fluorophore (e.g. 6-carboxyfluorescein or tetrachlorofluorescin) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "*Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), *The Maize Handbook, c*. 1994 by Springer-Verlag New York, Inc.: New York, N.Y., USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp) can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have a desired alteration in biomass composition. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

IX. ARTICLES OF MANUFACTURE

Transgenic plants provided herein have various uses in the agricultural and energy production industries. For example, transgenic plants described herein can be used to make animal feed (e.g., forage products) and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such transgenic plants provide higher yields of ethanol, butanol, dimethyl ether, other biofuel molecules, and/or sugar-derived co-products per kilogram of plant material, relative to control plants. Such processing efficiencies are believed to be derived from the composition of the plant material, including, but not limited to, content of glucan, cellulose, hemicellulose, and lignin. By providing higher biomass yields at an equivalent or even decreased cost of production, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

X. EXAMPLES

Example 1

GA 20-Oxidase Overexpressing Rice Plants

A rice plant of the Kitaake variety was transformed with a vector intended to overexpress a transgene expected to produce a known phenotype. The phenotype of one transformation event unexpectedly showed a dramatic increase in height. Sequencing of the rice genomic DNA flanking the vector insertion site revealed that the insertion occurred about 8 kb 5' of the OsGA20ox1 gene. Overexpression of the OsGA20ox1 sequence was observed by RT-PCR. The morphology of the transformed plant was very similar to one previously reported for activation-tagged and transgenic OsGA20ox1 overexpressing rice plants (see Oikawa, et al., 2004, supra). These results indicated that the increase in height and the morphology observed for this plant were due to trans-activation of the rice OsGA20ox1 gene rather than expression of the transgene per se.

Rice plants of the Kitaake variety were transformed separately with a vector to overexpress the transgene encoding a GA20-oxidase enzyme CeresAnnot: 8631464 (SEQ ID NO: 473) from *Sorghum bicolor*, GID1 GA receptor gene CeresClone:1857760 (SEQ ID NO: 101) from *Panicum virgatum*, or RNAi construct (SEQ ID NO: 1568) designed to target the rice locus for SLR1, Os03g49990 (CeresAnnot: 200242600), a gene encoding a DELLA protein. The phenotype of GA20-oxidase and GID1 transformation events showed dramatic increases in height. For the GA20-oxidase enzyme, overexpression of the sequence was observed by RT-PCR. This analysis of expression levels was not conducted for GID1 GA receptor or SLR1 RNAi. The morphology of the plants transformed with the GA20-oxidase and GID1 GA receptor sequences was very similar to the transgenic line described above for OsGA20ox1.

Nucleic acids for GID1 GA receptor, GA20-oxidase enzyme, and SLR1 RNAi were isolated from *Panicum virgatum, Sorghum bicolor*, and *Oryza sativa*, respectively, and cloned into a Ti plasmid vector, CV2, under the control of a PD3580 promoter, which is disclosed in WO2009/146015. Each construct contained a NPTII gene which confers paramyosin resistance to transformed plants. The presence of each vector containing a nucleic acid described above in the respective transgenic rice lines transformed with the vector was confirmed by paramyosin resistance, PCR amplification from green leaf tissue extract, and/or sequencing of PCR products.

*Sorghum* plants of the Wheatland and BTx430 varieties were transformed with a vector to overexpress the transgene encoding a GA20-oxidase enzyme CeresAnnot: 8631464 (SEQ ID NO: 473) from *Sorghum bicolor*. The vector was the same as that described above for the rice transformation.

Example 2

Cellulosic Biomass Conversion Characteristics of Rice Plants Overexpressing a Rice GA 20-Oxidase The transformed plant of Example 1 that was found to overexpress the OsGA20ox1 was crossed to a wild type rice plant. The progeny of the cross segregated 1:1 for the transgene and morphological phenotype. Biomass of transgenic (RiceS-1 No. 2 and RiceS-1 No. 4) and non-transgenic segregants (RiceS-1 No. 10) was harvested at maturity (after three months of growth) and subjected to a conversion assay as follows.

The yield of conversion can be directly calculated as follows: [PLN value+SAC value]/amount of biomass weight, where "PLN" refers to pretreatment liquor neutralized, and "SAC" refers to the sugar value from the saccharification analysis.

The following procedures were used to obtain the PLN and SAC values.

Sample Preparation and Milling:

Samples were prepared for analysis by drying the tissue samples for at least 3 days in an incubator set at 45° C. Dried tissues were milled using a Wiley Mill fitted with 2 mm mesh filter.

Microwave Pretreatment:

Milled tissues were weighed to obtain approximately 0.025 g. The moisture content of the weighed tissues was determined using the Denver Moisture Content analyzer. Tissues were transferred into separate Biotage microwave vials that were previously tared. Appropriate volume of sulfuric acid was then added into the samples to give a final concentration of 1.3% (w/w) in aqueous solution. Samples were pretreated in the Biotage microwave using the following settings: 160° C., 5 minutes, very high absorbance, 2.0-5.0 vial, 600 rpm stir speed (SWAVE default). The vials with the microwaved samples were centrifuged at 4000 rpm for 5 min with a deceleration rate set at ≤5. A minimum of 4 ml of PL (pretreated liquor) from each vial was transferred into pre-labeled 15 ml Corning conical tubes. The pH of the PL fraction was measured. The PL was directly neutralized with calcium carbonate ($CaCO_3$) for PLN and subsequent HPLC analysis or kept frozen until ready to analyze. The solid residue in each vial was washed several times by adding 5 ml water followed by centrifugation step at 4000 rpm for 5 min. The pH of the wash was monitored until it reached between 5 and 6 using appropriate pH indicator strips. The solid fraction was stored for saccharification analysis.

Pretreatment Liquor Analysis:

To determine PLN, calcium carbonate ($CaCO_3$) was added to an appropriate aliquot of each PL fraction until its pH reached between 5 and 6. The neutralized mixture was centrifuged at 4000 rpm for 2 min; after which 2 ml of the neutralized liquor was transferred to storage tubes.

To determine the amount of sugar released after acid pretreatment, the neutralized fraction (PLN) was analyzed by HPLC. Table 1 presents the amount of glucose (GLC) and xylose (XYL) released as PLN mg GLC/g dry biomass and PLN mg XYL/g dry biomass for the transgenic (RiceS-1 No. 2 and No. 4) and wild-type (RiceS-1 No. 10) plants.

Saccharification Analysis:

Water was added to the solid fraction obtained from the microwave pretreatment. A solution of citrate buffer (50 mM final), tetracycline (0.04 mg/mL final), cycloheximide (0.03 mg/mL final), Spezyme® and Novozyme 188 was added to make 20 mg or 2 mg enzyme/g dry biomass. The reaction mixture was then incubated at 50° C. in a rotating incubator. After 24 hours of incubation, an aliquot from the reaction was transferred to a microcentrifuge tube. The reaction was stopped by boiling the mixture for 5 min. The mixture was centrifuged for 2 min at 14,000 rpm. The supernatant was removed for sugar analysis (glucose monomers) by HPLC. Table 1 presents the amount of glucose (GLC) and xylose (XYL) released after enzymatic hydrolysis as SAC mg GLC/g dry biomass and SAC mg XYL/g dry biomass for the transgenic (RiceS-1 No. 2 and No. 4) and wild-type (RiceS-1 No. 10) plants. Table 1 also presents the total glucose and total xylose released (total from the PLN and SAC assays) for the transgenic and wild-type plants.

TABLE 1

| Sample (mg enzyme) | SAC mg GLC/g dry biomass | SD | SAC mg XYL/g dry biomass | SD |
|---|---|---|---|---|
| RiceS-1 No. 2 (20) | 221.5 | 3.9 | 6.5 | 0.4 |
| RiceS-1 No. 2 (2) | 134.1 | 3.3 | 0.2 | 0.3 |
| RiceS-1 No. 4 (20) | 202.4 | 1.8 | 4.6 | 0.2 |
| RiceS-1 No. 4 (2) | 124.3 | 3.5 | 0.4 | 0.1 |
| RiceS-1 No. 10 (20) | 280.1 | 4.9 | 7.6 | 0.4 |
| RiceS-1 No. 10 (2) | 143.0 | 0.0 | 0.3 | 0.3 |

| Sample | PLN mg GLC/g dry biomass | SD | PLN mg XYL/g dry biomass | SD |
|---|---|---|---|---|
| RiceS-1 No. 2 (20) | 154.1 | 11.6 | 124.4 | 0.6 |
| RiceS-1 No. 2 (2) | 168.1 | 3.8 | 120.9 | 1.6 |
| RiceS-1 No. 4 (20) | 209.4 | 4.2 | 114.0 | 2.3 |
| RiceS-1 No. 4 (2) | 211.7 | 2.6 | 117.2 | 3.8 |
| RiceS-1 No. 10 (20) | 28.5 | 0.1 | 155.3 | 1.6 |
| RiceS-1 No. 10 (2) | 25.1 | 0.2 | 146.0 | 1.4 |

| Sample | Total Glucose release | SD | Total Xylose release | SD |
|---|---|---|---|---|
| RiceS-1 No. 2 (20) | 375.6 | 15.5 | 130.9 | 1.0 |
| RiceS-1 No. 2 (2) | 302.2 | 7.1 | 121.1 | 1.9 |
| RiceS-1 No. 4 (20) | 411.8 | 6.0 | 118.6 | 2.5 |
| RiceS-1 No. 4 (2) | 336.0 | 6.1 | 117.6 | 3.9 |
| RiceS-1 No. 10 (20) | 308.6 | 5.0 | 162.9 | 2.0 |
| RiceS-1 No. 10 (2) | 168.1 | 0.2 | 146.3 | 1.7 |

Example 3

Cellulosic Biomass Conversion Characteristics of Rice Plants Overexpressing a GA 20-Oxidase Sequence From *Sorghum bicolor*

The transformed rice plants of Example 1 overexpressing the GA 20-oxidase sequence from *Sorghum bicolor* (SEQ ID NO:473) were analyzed for cellulosic biomass conversion characteristics. All plants were of the primary transformant generation, T0. Control plants included plants derived from the same transformation procedure as the transgenic lines but that tested negative for PCR products associated with the transgenes.

The yield of conversion can be directly calculated as follows: [PLN value+SAC value]/amount of biomass weight, where "PLN" refers to pretreatment liquor neutralized, and "SAC" refers to the sugar value from the saccharification analysis. The following procedures were used to obtain the PLN values.

Sample preparation and milling, microwave pretreatment, and pretreatment liquor analysis for GLC only were carried out as described in Example 2.

Saccharification Analysis:

Water was added to the solid fraction obtained from the microwave pretreatment. A solution of citrate buffer (50 mM final), tetracycline (0.04 mg/ml final), cycloheximide (0.03 mg/ml final), Novozyme CTec2 was added to make 20 mg, 2 mg, or 1 mg enzyme/g dry biomass. The reaction mixture was then incubated at 50° C. in a rotating incubator. After 24 hours of incubation, an aliquot from the reaction was transferred to a microcentrifuge tube. The reaction was stopped by boiling the mixture for 5 min. The mixture was centrifuged for 2 min at 14,000 rpm. The supernatant was removed for sugar analysis (glucose monomers) by HPLC.

Determining Sucrose and Glucose in Dry Biomass:

Accelerated Solvent Extractor (Dionex ASE 200) cells (22 ml stainless steel cells, Cat no. 049561) were filled with milled biomass (2 mm) Samples were loaded in ASE 200 and both sucrose and glucose compounds in the biomass were extracted using water as a solvent. During the extraction, the cells were filled with water and heated to 100° C. and 1500 psi pressure. The extracts were collected in vials. Volume of the extracts was measured accurately and a homogenized subset of the sample was used to run HPLC to determine the sugar profile.

Two sets of samples were used to characterize the sugars extractable in pretreatment. For one sample set, sucrose and glucose were extracted and measured as explained above to determine the SUG value in Table 2, which is the sum of free glucose and glucose theoretically generated by sucrose hydrolysis. The other sample set was subjected to PLN analysis to determine total glucose (GLC in the PLN group) in Table 2.

HPLC:

The neutralized sample from PLN and extracts from ASE were run on HPLC (Agilent 1100 series) to determine the sugar profile. A HPLC carbohydrate analysis column (Aminex® HPX-87P column) was used for the sugar analysis. The column was heated at 80° C. and the flow rate was set at 0.6 ml/min and 1 ml/min for analyzing PLN and ASE extracts, respectively. Corona® CAD® detector (Thermo Scientific) was used to analyze the sugar samples. The data was analyzed using Agilent Chemstation software.

Table 2 presents the amount of glucose (GLC) released after both pretreatment (PLN GLC) and saccharification enzymatic hydrolysis (SAC GLC) as determined for three separate enzyme dose levels (20 mg, 10 mg, and 1 mg) for transgenic and non-transgenic control plants. The GLC from PLN, SUG, and associated standard deviations (SD) were determined based on two replicate samples from a single plant for each enzyme dose level for a total of six samples. CW/Starch (mg/g Dry biomass) was then calculated by subtracting the SUG from the GLC to determine the remaining amount of glucose from cell wall release and starch combined. Subsequent evaluations demonstrated that the starch only accounts for a small proportion of the PLN (CW/Starch) (see Example 4). The glucose released from saccharification and associated standard deviations (SD) were measured from two sample replicates for each enzyme dose level. The total GLC was calculated as the sum of PLN GLC and SAC GLC.

Example 4

Biomass Conversion Characteristics of Rice Plants Overexpressing a GID1 GA Receptor Sequence from *Panicum virgatum* and Rice Plants Overexpressing an RNAi Construct for the Rice SLR1 Gene Three events of the transformed rice plants of Example 1 overexpressing the GID1 GA receptor encoding sequence (SEQ ID NO: 101) were designated Os1043-12, Os1043-13, and Os1043-18. Three events of the transformed plants of Example 1 overexpressing the SLR1 RNAi sequence (SEQ ID NO: 1568) were designated Os1044-06, Os1044-19, and Os1044-27. All plants were of the primary transformant generation, T0. Control plants included untransformed wild-type plants and plants derived from the same transformation procedure as the transgenic lines but that tested negative for PCR products associated with the transgenes.

Sample preparation, milling, microwave pretreatment, and pretreatment liquor analysis were carried out as described in Example 2 for GLC only. Determining sucrose and glucose in dry biomass, and HPLC were carried out as described in Example 3.

Determining Starch in Dry Biomass:

Finely milled (0.5 mm) biomass was used to analyze the starch content in biomass. Megazyme Total Starch assay kit (K-TSTA) was used for determining starch content of the biomass. The absorbance for each sample was read and the D-glucose control (supplied with the kit) at 510 nm against the reagent blank using a spectrophotometer (Agilent 8453 UV-Vis).

Table 3 presents the amount of glucose (GLC) released after pretreatment (PLN GLC) and its portion released from cell wall for transgenic and control plants. The data for each

TABLE 2

| | PLN GLC | | | | SAC GLC | | | |
|---|---|---|---|---|---|---|---|---|
| | GLC (mg/gDry biomass) | SUG (mg/gDry biomass) | CW/Starch (mg/gDry biomass) | SD | Enzyme dose | GLC (mg/gDry biomass) | SD | Total GLC | SD |
| Control (NT) | 63.4 | 35.4 | 28.1 | 4.1 | 20 mg | 211.6 | 1.2 | 275.0 | 5.3 |
| | 63.4 | 35.4 | 28.1 | 4.1 | 2 mg | 158.7 | 10.3 | 222.1 | 14.4 |
| | 63.4 | 35.4 | 28.1 | 4.1 | 1 mg | 136.8 | 14.8 | 200.3 | 18.9 |
| Transgenic | 182.2 | 91.6 | 90.6 | 7.8 | 20 mg | 179.7 | 6.5 | 361.9 | 14.3 |
| | 182.2 | 91.6 | 90.6 | 7.8 | 2 mg | 143.2 | 2.3 | 325.4 | 10.1 |
| | 182.2 | 91.6 | 90.6 | 7.8 | 1 mg | 115.3 | 8.4 | 297.5 | 16.2 |

The results demonstrate that the total glucose released increased in transgenic rice plants overexpressing the GA 20-oxidase sequence from *Sorghum bicolor* in comparison to non-transgenic control plants. This increase is based on the significant increases in sugar and glucose release from pretreatment alone (PLN SUG and GLC) and in a greater mobilization of cell wall material in pretreatment to increase PLN (CW/starch). The increase in PLN (CW/starch) increases conversion efficiency with more cell wall material released.

event were based on the average of two tissue sample replicates for single plants. Total free glucose was determined using separate sets of samples of dry material that was placed in aqueous solution and run through HPLC analyses, then total free glucose was calculated by adding half of the sucrose to the glucose measured (HPLC data not shown). Glucose from cell wall was calculated by subtracting the total free sugar value and the total starch value from the PNL glucose value.

TABLE 3

| Samples | PLN GLC (mg/gDry biomass) | PLN (SD) | Total free GLC (mg/gDry biomass) | Total Starch (mg/gDry biomass) | GLC from Cell Wall (mg/gDry biomass) | Plant height (cm) | Heading time (days) |
|---|---|---|---|---|---|---|---|
| WT | 84.8 | 4.1 | 47.5 | 18.6 | 18.7 | 97 | 41 |
| PCR - | 79.4 | 8.0 | 46.0 | 16.4 | 17.0 | 81 | 39 |
| Os1043-12 | 61.8 | 7.0 | 20.9 | 12.5 | 28.4 | 126 | 40 |
| Os1043-13 | 68.7 | 4.7 | 30.0 | 07.6 | 31.1 | 116 | 41 |
| Os1043-18 | 99.8 | 3.5 | 39.8 | 21.7 | 38.3 | 118 | 41 |
| Os1044-06 | 117.5 | 0.0 | 40.8 | 22.9 | 53.8 | 100 | 44 |
| Os1044-19 | 63.3 | 0.7 | 31.9 | 13.0 | 18.4 | 89 | 38 |
| Os1044-27 | 110.1 | 6.7 | 38.2 | 30.4 | 41.5 | 93 | 41 |

The results demonstrate that the total glucose released by pretreatment from cell wall increased in transgenic rice plants overexpressing the GID1 GA receptor sequence from *Panicum virgatum* or the RNAi construct targeting SLR1 in comparison to control plants. This increase is based on the significant increase in sugar release from a greater mobilization of cell wall material in pretreatment to increase glucose from the cell wall. The increase in availability of sugars from cell wall improves conversion characteristics.

Example 5

Sugar Characteristics of *Sorghum* Plants Overexpressing GA 20-Oxidase Sequence from *Sorghum bicolor*

Four events of the transformed *sorghum* plants of Example 1 overexpressing the GA20-oxidase enzyme from *Sorghum bicolor* (SEQ ID NO:473) were designated SbGA20-054, SbGA20-071, SbGA20-048, and SbGA20-52. All plants were of the primary transformant generation, T0, in the *sorghum* variety Wheatland. Control plants were of the Wheatland variety and grown from seed. SbGA20-054 was treated as a negative control based on short height phenotype that matched the control.

Five stalk juice samples were harvested at approximately soft to hard dough stages. After harvesting, the Brix value of each juice sample was measured. HPLC was carried out as described in Example 3, except that juice samples were used instead of dry material derived samples and the amount of fructose (FRU) was also measured.

Table 4 presents the Brix and HPLC-determined sugar profiles from juice samples of transgenic and control plants. The data for each event were based on one juice sample for single plants.

respectively, although an increase in sugar concentration was seen in all cases. Combining stature and juice yield with sugar profile, the significant advantage of increased sugar yield associated with the transgenic events becomes apparent in comparison to the controls.

Example 6

*Sorghum* seeds are planted in the field and allowed to germinate. At 2 week intervals following planting, the field is sprayed with GA3 at the rate of 50 g per hectare. Biomass of *sorghum* plants from the field is harvested about four months after planting. The biomass is subjected to a cellulosic sugar extraction process (see Example 2) for use in ethanol fermentation. The process results in increased sugars and/or requires lower amounts of the saccharification enzyme cocktail for sugar release per unit biomass, as compared to similar processing of biomass of *sorghum* plants of the same variety grown in under the same field conditions except for gibberellin treatment.

Example 7

*Miscanthus* plantlets are transplanted to a field. At 2 week intervals during the second growing season, the field is sprayed with GA3 at a rate of 50 gm per hectare. Biomass from the field is harvested and subjected to a pretreatment and enzymatic saccharification process (see Example 2). The process yields increased sugars and/or requires lower amounts of the saccharification enzyme cocktail for sugar release per unit biomass, as compared to similar processing of biomass of *Miscanthus* plants of the same variety grown in under the same field conditions except for gibberellin treatment.

TABLE 4

| Stature | Sample | PCR | Brix % | SUC (mg/ml) | GLC (mg/ml) | FRU (mg/ml) | Total (mg/ml) | Sucrose Purity (%) | Juice volume (ml juice/Stalk) | Sugar Yield (mg sugar/Stalk) |
|---|---|---|---|---|---|---|---|---|---|---|
| Control (Short) | Wheatland | - | 6.5 | 13.1 | 0.7 | 0.2 | 14.0 | 93.7% | 27.5 | 385.8 |
| Short | SbGA20-054 | + | 13.3 | 71.8 | 2.1 | 1.5 | 75.3 | 95.3% | 7.5 | 564.9 |
| Tall | SbGA20-071 | + | 11.2 | 69.5 | 2.2 | 1.5 | 73.2 | 95.0% | 25.0 | 1830.8 |
| Tall | SbGA20-048 | + | 14.2 | 82.1 | 2.2 | 1.7 | 86.0 | 95.4% | 40.0 | 3442.0 |
| Tall | SbGA20-052 | + | 7.6 | 30.7 | 1.5 | 1.1 | 33.3 | 92.2% | 75.0 | 2495.3 |

The SbGA20-071, SbGA20-048, SbGA20-052 transgenic lines all showed an increase in plant height in comparison to control plants.

Total sugar values for SbGA20-054 and SbGA20-052 deviated from the expected trend at 75.3 and 33.3 mg/ml, Example 8

Switchgrass seeds are planted in the field and allowed to germinate. At 2 week intervals during the third growing season, the field is sprayed with GA3 at the rate of 50 gm per hectare. Biomass from the field is harvested and subjected to a pretreatment and enzymatic saccharification process. The process yields increased sugars and/or requires lower amounts of the saccharification enzyme cocktail for sugar release per unit biomass, as compared to similar processing of biomass of switchgrass plants of the same variety grown in under the same field conditions except for gibberellin treatment.

Example 9

Sugarcane stalk cuttings are transplanted to a field. At 2 week intervals during the growing season, the field is sprayed with GA3 at a rate of 50 gm per hectare. Biomass from the field is harvested and subjected to a pretreatment and enzymatic saccharification process (see Example 2). The process yields increased sugars and/or requires lower amounts of the saccharification enzyme cocktail for sugar release per unit biomass, as compared to similar processing of biomass of sugarcane plants of the same variety grown in under the same field conditions except for gibberellin treatment.

Example 10

Determination of Functional Homologs by Reciprocal BLAST®

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST® process, a specific reference polypeptide was searched against all peptides from its source species using BLAST® in order to identify polypeptides having BLAST® sequence identity of 80% or greater to the reference polypeptide and an alignment length of 85% or greater along the shorter sequence in the alignment. The reference polypeptide and any of the aforementioned identified polypeptides were designated as a cluster.

The BLASTP® version 2.0 program from Washington University at Saint Louis, Mo., USA was used to determine BLAST® sequence identity and E-value. The BLASTP® version 2.0 program includes the following parameters: 1) an E-value cutoff of 1.0e-5; 2) a word size of 5; and 3) the -postsw option. The BLAST® sequence identity was calculated based on the alignment of the first BLAST® HSP (High-scoring Segment Pairs) of the identified potential functional homolog sequence with a specific reference polypeptide. The number of identically matched residues in the BLAST® HSP alignment was divided by the HSP length, and then multiplied by 100 to get the BLAST® sequence identity. The HSP length typically included gaps in the alignment, but in some cases gaps were excluded.

The main Reciprocal BLAST® process consists of two rounds of BLAST® searches; forward search and reverse search. In the forward search step, a reference polypeptide sequence, "polypeptide A," from source species SA was BLASTed® against all protein sequences from a species of interest. Top hits were determined using an E-value cutoff of 10-5 and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed® against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NOs: 471, 99, 188, 1, 287, 1429, 1542, 1386, and 1274 are shown in FIGS. 1-9, respectively. Additional exemplary homologs are correlated to certain Figures in the Sequence Listing.

Example 11

Determination of Functional Homologs by Hidden Markov Models

Hidden Markov Models (HMMs) were generated by the program HMMER 3.0. To generate each HMM, the default HMMER 3.0 program parameters were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO: 471.

The procedure above was repeated and an HMM was generated for each group of sequences shown in FIGS. 1-9, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1580 sequences)

SEQ ID NO: 1 - protein, 369 aa, Triticum aestivum
  misc_feature (1)..(369): Public GI ID no. 85540948
  misc_feature (209)..(306): Pfam Name: 2OG-FeII_Oxy Pfam Description: 2OG-Fe(II) oxygenase superfamily
  misc_feature (1)..(369): Bit score of 598.1 for HMM based on sequences of Figure 4
  misc_feature (1)..(369): in Figure 4
MPTPAHLSKDPHYFDFRAARRVPETHAWPGLHDHPVVDGSGAGGEPDAVPVVDMRDPFAAEAVGLAAQDWGAFLLVGHGVPLDLLVRVEAAIAGMFALPASEKMRAVRRPGDSCGYGSPPISSFFSKCMWSEGYTFSPANLRSDLRKLWPKAGHDYRHFCAVMEEFHREMRALADKLLELFLVALGLTGEQVAAVESEQKIAETMTATMHLNWYPKCPDPKRALGLIAHTDSGFFTFVLQSLVPGLQLFRHGPDRWVTVPAVPGAMVVNVGDLFQILTNGRFHSVYHRAVVNRESDRISLGYFLGPPAHVKVAPLREALAGTPAAYRAVTWPEYMGVRKKAFTTGASALKMVAISTDDAANDTDDLILS

SEQ ID NO: 2 - protein, 369 aa, Hordeum vulgare
  misc_feature (1)..(369): Public GI ID no. 49065952
  misc_feature (1)..(369): Hordeum vulgare subsp. vulgare
  misc_feature (209)..(306): Pfam Name: 2OG-FeII_Oxy Pfam Description: 2OG-Fe(II) oxygenase superfamily
  misc_feature (1)..(369): Bit score of 598.3 for HMM based on sequences of Figure 4
  misc_feature (1)..(369): Functional Homolog Of SEQ ID NO. 1
  misc_feature (1)..(369): in Figure 4
MPTPSHLSKDPHYFDFRAARRVPETHAWPGLHDHPVVDGGGAGGGPDAVPVVDMRDPCAAEAVALAAQDWGAFLLQGHGVPLELLARVEAAIAGMFALPASEKMRAVRRPGDSCGYGSPPISSFFSKCMWSEGYTFSPANLRSDLRKLWPKAGHDYRHFCAVMEEFHREMRVLADKLLELFLVALGLTGEQVAAVESEHKIAETMTATMHLNWYPKCPDPKRALGLIAHTDSGFFTFVLQSLVPGLQLFRHGPDRWVTVPAVPGAMVVNVGDLFHILTNGRFHSVYHRAVVNRDSDRISLGYFLGPPAHVKVAPLREALAGTPAAYRAVTWPEYMGVRKKAFTTGASALKMVAISTDDAADVLPDVLSS

SEQ ID NO: 3 - protein, 368 aa, Dasypyrum villosum
  misc_feature (1)..(368): Public GI ID no. 157683561
  misc_feature (209)..(306): Pfam Name: 2OG-FeII_Oxy Pfam Description: 2OG-Fe(II) oxygenase superfamily
  misc_feature (1)..(368): Bit score of 594.8 for HMM based on sequences of Figure 4
  misc_feature (1)..(368): Functional Homolog Of SEQ ID NO. 1
  misc_feature (1)..(368): in Figure 4
MPTPSHLSNDPRYFDFRAARRVPETHAWPGLHDHPVVDGGEAGGGPDAVPVVDMRDPCAAEAVALAAQDWGAFLLEGHGVPLELLERVEAAIAGMFALPASEKMRAVRRPGDSCGYGSPPISSFFSKCMWSEGYTFSPANLRSDLRKLWPKAGHDYRHFCAVMEEFHREMRALADKLLELFLVALGLTVEQVAAVESEQQIAETMTATMHLNWYPKCPDPKRALGLIAHTDSGFFTFVLQSLVPGLQLFRHGPDRWVTVPAVPGAMVVNVGGLFQILTNGRFHSVYHRAVVNRDSDRISLGYFLGPPAHVKVAPLREALAGTPAAYRAVTWPEYMGVRKKAFTTGASALKMVAIPTDDAAAADDLISS

SEQ ID NO: 4 - protein, 372 aa, Avena sativa
  misc_feature (1)..(372): Public GI ID no. 291586147
  misc_feature (208)..(306): Pfam Name: 2OG-FeII_Oxy Pfam Description: 2OG-Fe(II) oxygenase superfamily
  misc_feature (1)..(372): Bit score of 576.4 for HMM based on sequences of Figure 4
  misc_feature (1)..(372): Functional Homolog Of SEQ ID NO. 1
  misc_feature (1)..(372): in Figure 4
MPTPAHLSKDPHYFDFRAARRVPETHAWPGLHEHPVVDGRAGAGEDAVLVVDTRDPGAAEAVARAAEQWGAFLLEGHGVSRELLQRVEARIAGMLALPAQEKMRAVRRPGDSCGYGSPPISSFFAKSMWSEGYTFSPANLRSDLRKLWPKQGHDYRLFCDVMEEFHGEMRALSDRLMELFLAALGLTGEQAAAVEAEHRIAETMTATMHLNWYPKCPDPKRALGLIAHTDSGFFTFVLQSLVPGLQLFRHGPDRWVTVPADVQDAFVVNVGDLFQILTNGRFHSVYHRAVVNRDSDRISLGYFHGPPADTKVAPLREAVGRTGGKPAYRAVTWPEYMAVRKKAFTTGASALKMVAIITSEFAADHTDDLISS

SEQ ID NO: 5 - DNA, 1170 bp, Sorghum bicolor
  misc_feature (1)..(1170): Ceres Annot ID no. 8658260
  misc_feature (1)..(1170): Encodes the peptide sequence at SEQ ID NO. 6
atgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctgtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtag

SEQ ID NO: 6 - protein, 389 aa, Sorghum bicolor
  misc_feature (1)..(389): Ceres Annot ID no. 8658260
  misc_feature (212)..(309): Pfam Name: 2OG-FeII_Oxy Pfam Description: 2OG-Fe(II) oxygenase superfamily
  misc_feature (1)..(389): Bit score of 589.9 for HMM based on sequences of Figure 4
  misc_feature (1)..(389): Functional Homolog Of SEQ ID NO. 1
  misc_feature (1)..(389): in Figure 4
MPTPSHLANPRYFDFRAARRVPETHAWPGLHDHPVVDGGAPGPDAVPVVDLAGAADEPRAAVVAQVARAAEQWGAFLLTGHGVPAELLARVEDRIATMFALPADDKMRAVRGPGDACGYGSPPISSFFSKCMWSEGYTFSPANLRADLRKLWPKAGDDYTSFCDVMEEFHKHMRALADKLLELFLMALGLTDEQVGGVEAERRIAETMTATMHLNWYPRCPDPRRALGLIAHTDSGFFTFVLQSLVPGLQLFRHAPDRWVAVPAVPGAFVVNVGDLFHILTNGRFHSVYHRAVVNRDLDRISLGYFLGPPPHAKVAPLREAVPPGRTPAYRAVTWPEYMGVRKKAFTTGASALKMVALAAAAAAADLDDDAGAGAAAEPVVHQQLLVSS

SEQ ID NO: 7 - DNA, 1721 bp, Panicum virgatum
  misc_feature (1)..(1721): Ceres Clone ID no. 1784588
  misc_feature (1)..(1721): Encodes the peptide sequence at SEQ ID NO. 8
acacttctctcctcctcataccactagtgcaaggtcctagatttacacttcttggtgcttgcttagcttgtttctttctagcaacgataattgctagcagctagctcagctggtagtcagtggcctggcctggtgtgatctattggccgaccggccggccgggatcaggggttaacggtgagtactactagctagctagctagctcataagcaagcaaagcaagcagcaggcaaggccggccggagatgccgacgccgtcgcacctcaagaacccgctctacttcgacttccgcgcggcgcggcgcgtgcccgagtcgcacgcctggccggggctgcacgagcaccccgtcgtggacggcggcggcgcgccggggacgccggacgccgtgccggtggtggacctgcgggagtccggcgcggcggcggcggccggcgtggcgcgcgccgccgagctgtggggcgcgttcctgctcaccgggcacggcgtccccgcggagctcctggcgcgcgtcgaggaccggatcgcgcgcatgttcgcgctgccggccgccgacaagatgcgcgccgtgcgcgggcccggcgacgcctgcggctacggctcgccgcccatctcctccttcttctccaagtgcatgtggtccgagggctacaccttctcgccggcctccctccgcgccgacctccgcaagctctggcccaaggccggcgacgactacgccagcttctgtgacgtgatggaggagttccacaaggagatgcgcgtcctggccggcaagctgctggagctcttcctcagggcgctcgggctcaccgacgaggaggtcgccgccgtcgaggaggagcggcggatcggcgagacgatgaccaccaccatgcacctcaactggtatccaaggtgcccggacccgcggcgcgcgctggggctgatcgcgcacacgaactcgggcttcttcaccttcgtgctgcagagcctcgtgccggggctgcagctgttccggcacgccccggaccggtgggtggcggtgccggccgtgccgggcgccttcgtcgtcaacgtcggcgacctcttccagatcctcaccaacggccgcttccacagcgtgtaccaccgcgccgtcgtgaaccgggacctggaccggatatcgctgggctacttcctcggcccgccgccgcacgccaaggtggcgccgctgcgggaggccgtgccgccgggccggacccccgcgtaccgcgccgtaacgtggcccgagtacatgggcgtccgcaagaaggccttcaccaccggcgcctccgcgctcaagatggtcgccgccgccgccgccgaatccgacgacgccgacgtccaccagccgctcgtcctctcgtcgtagccgatcgatcgatcgccggagccgacaacgacgacgcataccgtacccccgagcatactaatcaaacaagcggcaaccccgatgaaatggcatccattctcgctcgcgcgcatgcagctagctagcggccggccttccgcacctgctcctcctcctctgccgctggctgtagaaaaagaaaactaattaagctgagaccaagacaaagacgaaacgaacggagaggaaaaggatatgctctctagctgtttcttctagttgcaggcaggctgctcccagccgagtttgtcgttactgaagatttatgaccctgattaaaaactaatctgaattaatgcatgtggtttggc

SEQ ID NO: 8 - protein, 374 aa, Panicum virgatum
  misc_feature (1)..(374): Ceres Clone ID no. 1784588
  misc_feature (210)..(307): Pfam Name: 2OG-FeII_Oxy Pfam Description: 2OG-Fe(II) oxygenase superfamily
  misc_feature (1)..(374): Bit score of 583.3 for HMM based on sequences of Figure 4
  misc_feature (1)..(374): Functional Homolog Of SEQ ID NO. 1
  misc_feature (1)..(374): in Figure 4
MPTPSHLKNPLYFDFRAARRVPESHAWPGLHEHPVVDGGGAPGTPDAVPVVDLRESGAAAAAGVARAAELWGAFLLTGHGVPAELLARVEDRIARMFALPAADKMRAVRGPGDACGYGSPPISSFFSKCMWSEGYTFSPASLRADLRKLWPKAGDDYASFCDVMEEFHKEMRVLAGKLLELFLRALGLTDEEVAAVEEERRIGETMTTTMHLNWYPRCPDPRRALGLIAHTNSGFFTFVLQSLVPGLQLFRHAPDRWVAVPAVPGAFVVNVGDLFQILTNGRFHSVYHRAVVNRDLDRISLGYFLGPPPHAKVAPLREAVPPGRTPAYRAVTWPEYMGVRKKAFTTGASALKMVAAAAAESDDADVHQPLVLSS

SEQ ID NO: 9 - protein, 373 aa, Oryza sativa
  misc_feature (1)..(373): Public GI ID no. 15005015
  misc_feature (1)..(373): Oryza sativa Indica Group
  misc_feature (209)..(304): Pfam Name: 2OG-FeII_Oxy Pfam Description: 2OG-Fe(II) oxygenase superfamily
  misc_feature (1)..(373): Bit score of 577.2 for HMM based on sequences of Figure 4
  misc_feature (1)..(373): Functional Homolog Of SEQ ID NO. 1
  misc_feature (1)..(373): in Figure 4
MPTPSHLKNPLCFDFRAARRVPETHAWPGLDDHPVVDGGGGGGEDAVPVVDVRAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 10 - protein, 374 aa, Zea mays
  misc_feature (1)..(374): Public GI ID no. 194700302
  misc_feature (219)..(311): Pfam Name: 2OG-FeII_Oxy Pfam Description: 2OG-Fe(II) oxygenase superfamily
  misc_feature (1)..(374): Bit score of 500.7 for HMM based on sequences of Figure 4
  misc_feature (1)..(374): Functional Homolog Of SEQ ID NO. 1
  misc_feature (1)..(374): in Figure 4
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKARAGRRPGEPTATGYGRPPLALRFSKLMWSEGYTFRAATVREEFRRVWPDGGDDYLRFCDVMEEYDREMRALGGRLLDLFFMALGLTDVQFATGETERRIRETWTATMHPILYPRCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 11 - protein, 365 aa, Allium fistulosum
  misc_feature (1)..(365): Public GI ID no. 188035730
  misc_feature (205)..(306): Pfam Name: 2OG-FeII_Oxy Pfam Description: 2OG-Fe(II) oxygenase superfamily
  misc_feature (1)..(365): Bit score of 551.5 for HMM based on sequences of Figure 4
  misc_feature (1)..(365): Functional Homolog Of SEQ ID NO. 1
  misc_feature (1)..(365): in Figure 4
MPSISMEQPIHFPQPIHHPKHFDLGSAHEVPDSHTWPTIQPNPPNGPNESIPVIDLSSPDVISLIGHACESWGVFQVISHGVDLNLLHNLESQARRLFSLPTQQKLKAGRSPNSISGYGLAPISSLFSKLMWSEGFTISGSPLDHARSLWPDDYFNFCEVIEEYNKEMKRVAERLMQLMLLSLGLTEETIKWAGPMNELQDISSVLQLNSYPACPNPDRAIGLAAHTDSSLLTILYQSNTSGLQVLRPNKESSPTQWVTVPPIPGALVVNVGDLCHILSNGRFHSVVHRAVVNRTEHRYSAAYICGPPAHVKVSPIVKPVGPAYRPITWREYLGIKARLFDKALASVIISEEDHNDNSTCLLSCV

SEQ ID NO: 12 - protein, 365 aa, Vitis vinifera
  misc_feature (1)..(365): Public GI ID no. 147852208
  misc_feature (203)..(299): Pfam Name: 2OG-FeII_Oxy Pfam Description: 2OG-Fe(II) oxygenase superfamily
  misc_feature (1)..(365): Bit score of 612.9 for HMM based on sequences of Figure 4
  misc_feature (1)..(365): Functional Homolog Of SEQ ID NO. 1
  misc_feature (1)..(365): in Figure 4
  misc_feature (275)..(275): Xaa is any aa, unknown, or other
MPSRISDAFKAHPLHLNHRHLDLNSVQELPDLYAWAGVDENPSGDSLITESVPVIDLTDPNASELVGHACKSWGVFQVTNHGIPGSLLDDIESAGRSLFSLPAQQKLKAARSPDGVAGYGLARISSFFNKLMWYEGFTIFGSPLEHARQLWPQDYTKFCDVTEEFEKEMNQLAERLMWLMLGSLGITKEDVNWAGSKGDFKAALQLNSYPACPEPDRAMGLAAHTDSSLFTILYQNTVSGLQVQREGAGWITVPPLPGALVINVGDLLHILSNGXFPSVVHRALVNRTKHRLSVAYLYGPPAGVPISPVPKLVDSTHPPLYRPVTWSEYLCTKAKHFDKALSLVRLCMPRNGFIDVNDHNGVKVG

SEQ ID NO: 13 - protein, 372 aa, Prunus subhirtella
  misc_feature (1)..(372): Public GI ID no. 61651585
  misc_feature (210)..(306): Pfam Name: 2OG-FeII_Oxy Pfam Description: 2OG-Fe(II) oxygenase superfamily
  misc_feature (1)..(372): Bit score of 627.3 for HMM based on sequences of Figure 4
  misc_feature (1)..(372): Functional Homolog Of SEQ ID NO. 1
  misc_feature (1)..(372): in Figure 4
MPARLSDAFKSHPLNLQLKHPDFSSLQELPDSYAWSQNDDQYPSSPGSFGAEQDSVPVIDLSDPNALKLTGHACRTWGVFQVTNHGIPSKLLDDIESAGRSLFSLPVQQKLKAARSPDGISGYGFARISSFFQKLMWSEGFTIVGSPLDHFRQLWPQDYNKFCNIIEEYEKVMKRLAGRLMWLMLGSLGISMEDVKWAGPKGDFRDASAALQLNSYPACPDPDRAMGLAAHTDSTLLTILYQNNTSGLQVLREGTGWVTVPPLPGALVVNVGDLIHILSNGLYPSVLHRAVVNRSRHRLSIAYLYGPPASVQISPLSKLLGPSQPPLYRPITWNEYLGTKAKHFNKALSSVRLCAPLNALVDVSDHNSVKVG

SEQ ID NO: 14 - protein, 368 aa, Rumex palustris
  misc_feature (1)..(368): Public GI ID no. 109729785
  misc_feature (208)..(304): Pfam Name: 2OG-FeII_Oxy Pfam Description: 2OG-Fe(II) oxygenase superfamily
  misc_feature (1)..(368): Bit score of 582.6 for HMM based on sequences of Figure 4
  misc_feature (1)..(368): Functional Homolog Of SEQ ID NO. 1
  misc_feature (1)..(368): in Figure 4
MPAPRIMDPYKDKSSHYHHRRHLDFQSVEELPDAYEWGPLESHGGPVGADQGVPIVDLKGPNARELIGSACKSWGAFQVINHGVPQRFLEEVESAGRRLFSLPLHQKLKAARAPDGVTGYGPARISSFFPKLLWSEGFTIFGSPEDHARQLWPQDYQNFCEIIEEYDRDMKRLAGRLMWLVLGSLGIAKDDVEWAGPTGDFNDTCSAALQLNSYPKCPNPGRAMGLAAHTDSTLLTILYQNNTTGLQVHRDGLGWVMVPPVPGALVVNIGDLLHILSNGLYPSVLHRAVVNRTHHRLSVAYLFGPPQSVRISPLERLVDPDHPALYRPISWTEYLSTKAKHFNKALSSVRLCGPPVDRTVSSIVEVGS

SEQ ID NO: 15 - protein, 356 aa, Chrysanthemum x morifolium
  misc_feature (1)..(356): Public GI ID no. 190192212
  misc_feature (194)..(290): Pfam Name: 2OG-FeII_Oxy Pfam Description: 2OG-Fe(II) oxygenase superfamily
  misc_feature (1)..(356): Bit score of 594.5 for HMM based on sequences of Figure 4
  misc_feature (1)..(356): Functional Homolog Of SEQ ID NO. 1
  misc_feature (1)..(356): in Figure 4
MHTNISMINQKHLDLNSMKVLPESHAWLSLESSPLYSSLSPDLVPVISLTDPNAMNLVGHACKTWGVFQVTNHGVPINLLEKMEAAGRKLFALPIQQKLKAARAPDGVSGYGVARISSFFPKLMWSEGFTIMGSPYEHALKLWPNSYTRFCDVIEEYKEEMNKLAQTLMSLMLGSLGVTMEDVKWAGSQGSCPALQLNSYPACPDPDRAMGLAAHTDSTLLTILHQNNTSGLQAHRDGAGWVTVPPIPGALVINVGDLLHILSNGLYPSVLHRAMVNRTKHRLSVAYLYGPPSNVQISPLSKLTDQVHPPLYRPVTWSEYLGTKAKHFNKALSSVRVCAPLNGFADANDHNGVQVG

SEQ ID NO: 16 - protein, 371 aa, Nicotiana tabacum
  misc_feature (1)..(371): Public GI ID no. 6691485
  misc_feature (209)..(305): Pfam Name: 2OG-FeII_Oxy Pfam Description: 2OG-Fe(II) oxygenase superfamily
  misc_feature (1)..(371): Bit score of 621.4 for HMM based on sequences of Figure 4
  misc_feature (1)..(371): Functional Homolog Of SEQ ID NO. 1
  misc_feature (1)..(371): in Figure 4
MPSRISDSFRAHSQKHLDLNSIKELPESHAWTSSNDYPSENSCNFESIPVIDLDNYINNNNINVLEHIGQACKKWGAFQIINHNISERLLQDIELAGKSLFSLPMQQKLKAARSPEGVTGYGVARISSFFSKLMWSEGFTIVGSPLEHARQIWPHDYQKFCDVIEEYEREMEKLAGRLMWLMLGSLGITKEEVKWAVCPKGESKGGSAALQLNSYPACPDPDRAMGLAAHTDSTILTILHQNNTSGLQVFKEGSGWVTVPPFPGALVVNVGDLLHILSNGLYPSVLHRAVVNRTRHRLSVAYLYGPPSRVKVSPLAKLVDQRHPPLYRAVTWSEYLGTKARHFDKALSSVRLCAPLSGFTDAKDHNGVQVG

SEQ ID NO: 17 - protein, 377 aa, Medicago sativa
  misc_feature (1)..(377): Public GI ID no. 145206857
  misc_feature (1)..(377): Medicago sativa subsp. falcata
  misc_feature (213)..(309): Pfam Name: 2OG-FeII_Oxy Pfam Description: 2OG-Fe(II) oxygenase superfamily
  misc_feature (1)..(377): Bit score of 609.7 for HMM based on sequences of Figure 4
  misc_feature (1)..(377): Functional Homolog Of SEQ ID NO. 1
  misc_feature (1)..(377): in Figure 4
MPSLSEAYRAHPVHVNHKHPDFNSLQELPESYTWTHLDDHTLINSNNTMKESANSSSVPIIDLNDPNASKLIGHACKTWGVYQVVNHGIPISLLDEIQWLGQTLFTLPSHQKLKAIRSPDGVSGYGLARISSFFPKLMWSEGFTIVGSPLDHFRQLWPQDYAKHCDTVLQYDEAMKKLAGKLMWLMLDSLGITMEDIEWAGSKAQFDEKACAAMQLNSYPSCPDPDHAMGLAPHTDSTFLTILSQNDISGLQVQREGSGWVTVPPLHGGLVVNVGDLFHILSNGLYTSVLHRVLVNRTRQRFSVAYLYGPPSNVEICPHEKLVGPTQPPLYRSVTWNEYLGTKAKHFNKALSSVSLCAPINGLFDVNDSNKSSVQVG

SEQ ID NO: 18 - protein, 372 aa, Solanum tuberosum
  misc_feature (1)..(372): Public GI ID no. 225421147
  misc_feature (1)..(372): Solanum tuberosum subsp. andigenum
  misc_feature (210)..(306): Pfam Name: 2OG-FeII_Oxy Pfam Description: 2OG-Fe(II) oxygenase superfamily
  misc_feature (1)..(372): Bit score of 616.4 for HMM based on sequences of Figure 4
  misc_feature (1)..(372): Functional Homolog Of SEQ ID NO. 1
  misc_feature (1)..(372): in Figure 4
MPTRISDSFRPHHSQKHFDLNSIKELPESHAWTSSNDHYTQENSCNFESIPVIDLDNNNNNNNNILDHIGHACKKWGAFQIINHSISERLLQDIDVAGKTLFSLPMQQKLKAARSPDGVTGYGAAQISSLFSKLMWSEGFTIVGSPIEHARQLWPKDYKKFCEVIEEYEKEMEKLAGRLMWLILGSLGITKDEVKWAVGPKGETKEGCAALQLNSYPACPDPGRAMGLAAHTDSTILTILHQNNTSGLQVYQEGNGWVTVPPIPGALVVNVGDLLHILSNGSYPSVLHRAVVNRTRHRLSVAYLYGPPTGVRVSPLSKLLDHRHPPLYRAVTWSEYLGTKAKYFDKALSSVRLCVPLSGFADAKDHNGVQVG

SEQ ID NO: 19 - protein, 382 aa, Spinacia oleracea
  misc_feature (1)..(382): Public GI ID no. 27261175
  misc_feature (206)..(302): Pfam Name: 2OG-FeII_Oxy Pfam Description: 2OG-Fe(II) oxygenase superfamily
  misc_feature (1)..(382): Bit score of 573.8 for HMM based on sequences of Figure 4
  misc_feature (1)..(382): Functional Homolog Of SEQ ID NO. 1
  misc_feature (1)..(382): in Figure 4
MPSRPSRVVKEQHPTKKSFLDLESLNELPDSFAWGSFEDPCSIDNPSGYGPDSVPVINLQDPQAQQLVGLACRSWGVFQVTNHGIQKSLLDDIEAAGKSLFALPVNQKLKAARSSCGVTGYGPAGISSFFPKRMWSEGFTILGSPLDHARQLWPNNYNKFCDIIEKYQKEMNQLAKKLMQLVVGSLGISNQDIMNWADLLEGANGAMQLNSYPIRPDPNRAMGLAAHTDSTLLTILHQSNTTGLQVFRERSGWVTVPPISGGLVINIGDLLHILSNGRYPSVYHRAMVNRVQHRLSVAYLYGPASGVRVQPLPKLIDATHPPLYRPVTWSEYLGIKSEHLTKALSLIRINHNTNPSLTGLIGNDEPKSINVDSDKTILAVFG

SEQ ID NO: 20 - protein, 374 aa, Pisum sativum
  misc_feature (1)..(374): Public GI ID no. 2316018
  misc_feature (210)..(306): Pfam Name: 2OG-FeII_Oxy Pfam Description: 2OG-Fe(II) oxygenase superfamily
  misc_feature (1)..(374): Bit score of 606.1 for HMM based on sequences of Figure 4
  misc_feature (1)..(374): Functional Homolog Of SEQ ID NO. 1
  misc_feature (1)..(374): in Figure 4
MPSLSEAYRAHPVHVNHKHPDFNSLQELPESYNWTHLDDHTLIDSNNIMKESTTTVPVIDLNDPNASKLIGLACKTWGVYQVMNHGIPLSLLEDIQWLGQTLFSLPSHQKHKATRSPDGVSGYGIARISSFFPKLMWYEGFTIVGSPLDHFRELWPQDYTRFCDIVVQYDETMKKLAGTLMCLMLDSLGITKEDIKWAGSKAQFEKACAALQLNSYPSCPDPDHAMGLTPHTDSTFLTILSQNDISGLQVNREGSGWITVPPLQGGLVVNVGDLFHILSNGLYPSVLHRVLVNRTRQRFSVAYLYGPPSNVEICPHAKLIGPTKPPLYRSVTWNEYLGTKAKHFNKALSSVRLCTPINGLFDVNDSNKNSVQVG

SEQ ID NO: 21 - protein, 358 aa, Fragaria x ananassa
  misc_feature (1)..(358): Public GI ID no. 77632798
  misc_feature (206)..(303): Pfam Name: 2OG-FeII_Oxy Pfam Description: 2OG-Fe(II) oxygenase superfamily
  misc_feature (1)..(358): Bit score of 591.6 for HMM based on sequences of Figure 4
  misc_feature (1)..(358): Functional Homolog Of SEQ ID NO. 1
  misc_feature (1)..(358): in Figure 4
MPVRISEAFPSHPHKHYPADFNSLHELPDSYAWTNQLDECPSLDSSFGSDLCVPVIDLNDQNVIKLIGHACKTWGVFQVTNHGVPQKLVHDIESTCRSLFSLPVQQKLKAARPADGISGYGIHRISSFFQKLMWSEGFTLVGSPLEHFRQLWPQDYNKFCCMVEEYETEMKKLAGRLMWLIFGSLGISKEDVSWAGPKGDFEDASNALQLNSYPACPDPSRAMGLAEHTDSTLLTIIHQSNISGLQVLREGAGWLTVPPVAGALVINIGDLIHILSNGEYQNVFHRAIVNRSQQRLSVAYLYGPPINVQISPHSKLVTPSHPSLYRPVTWKEYLGIEGKLYNKALSSIKFHDHQNDQM

SEQ ID NO: 22 - protein, 372 aa, Selaginella moellendorffii
  misc_feature (1)..(372): Public GI ID no. 302811181
  misc_feature (233)..(329): Pfam Name: 2OG-FeII_Oxy Pfam Description: 2OG-Fe(II) oxygenase superfamily
  misc_feature (1)..(372): Bit score of 328.7 for HMM based on sequences of Figure 4
  misc_feature (1)..(372): Functional Homolog Of SEQ ID NO. 1
MMLGTTRLPSGLSQSPTPSSCGAQLLRSVSNVGSLSKMLERGQQLPEAYRWSSSETAAAEDDPAELEDEVVVPVIDLAELDRSDERRKEICEEMRSACREWGAFQVVNHGVPDQVVERARRTSLDLFALPESDKLRAERPPGTLFGYGATRMASFFNRLMWSEAFTMMGSPHNNFEAYARKLCVHSEQDFCKSFEEYDKAMRGLALLITDLILHGLEASEERIHQHIRNFWGMIHMNFYPPCPSPSEAMGLASHTDSSCLTIMHQGSVGGLQVKRGDKWIAIKPVPGAFVIQVGDMLQLMSNNVFHSALHRALVNERFERLSLVYFFTPPPTVSICPIHPSKPLYRCLTWNEYLQVKAKLFMGALDHFLLPE

SEQ ID NO: 23 - protein, 370 aa, Nicotiana sylvestris
  misc_feature (1)..(370): Public GI ID no. 20149245
  misc_feature (208)..(304): Pfam Name: 2OG-FeII_Oxy Pfam Description: 2OG-Fe(II) oxygenase superfamily
  misc_feature (1)..(370): Bit score of 615.7 for HMM based on sequences of Figure 4
  misc_feature (1)..(370): Functional Homolog Of SEQ ID NO. 1
MPFRISDSFRTHSQKHLDLNSIKELPESHAWTSSNDYPSENSCNFESIPVIDLNNNNHNNINVLEHIGQACKKWGAFQIINHNISERLLQDIELAGKNLFSLPMQQKLKAARSPDGVTGYGVARISSFFSKLMWSEGFTIVGSPLEHARQIWPQDYKKFCDAIEEYEREMEKLAGRLMWLMLGSLGITKEDVNWAVGPKGESKGGSAALQLNSYPACPDPDRAMGLAAHTDSTILTILHQNNTSGLQVFKEGSGWVTVPPFLGALVVNVGDLLHILSNGSYPSVLHRAVVNRTRHRLSVAYLYGPPSGVKISPLAKLVDQRHPPLYRAITWSEYLGTKAKHFDKALSSVRLCAPLTGFADAKDHNGVQVG

SEQ ID NO: 24 - protein, 288 aa, Oryza sativa
  misc_feature (1)..(288): Public GI ID no. 15004943
  misc_feature (209)..(254): Pfam Name: 2OG-FeII_Oxy Pfam Description: 2OG-Fe(II) oxygenase superfamily
  misc_feature (1)..(288): Bit score of 383.3 for HMM based on sequences of Figure 4
  misc_feature (1)..(288): Functional Homolog Of SEQ ID NO. 1
MPTPSHLKNPLCFDFRAARRVPETHAWPGLDDHPVVDGGGGGGEDAVPVVDVGAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPTGGWRCRRWRGPSSSTSATSSTSSPTAASTASTTAPS

SEQ ID NO: 25 - protein, 358 aa, Arabidopsis lyrata
  misc_feature (1)..(358): Public GI ID no. 297849984
  misc_feature (1)..(358): Arabidopsis lyrata subsp. lyrata
  misc_feature (211)..(305): Pfam Name: 2OG-FeII_Oxy Pfam Description: 2OG-Fe(II) oxygenase superfamily
  misc_feature (1)..(358): Bit score of 508.1 for HMM based on sequences of Figure 4
  misc_feature (1)..(358): Functional Homolog Of SEQ ID NO. 1
MPAMLTDVFRGHPIHLPHSHQPDFTSLRELPDSYKWTPKDDLLFAAAPSPPTTGENIPLIDLDHPDAANQIGHACRTWGAFQIANHGVPLGLLQDIEFLTGSLFRLPVQRKLKAARSETGVSGYGVARIASFFNKKMWSEGFTITGSPLNDFRKLWPQLHLNYCDIVEEYEEQMKKLASKLMWLALKSLGVSEEDVEWASLNSDLNWAQAALQLNHYPVCPEPDRAMGLAAHTDSTLLTILCQNNTAGLQVFRDDLGWVTVPPVPGSLVVNVGDLFHILSNGLFKSVLHRARVNQTRARLSVAFLWGPQSDIKISPVPKLVSPVELPLYRSVTWTEYLRTKATHFNKALSMIRNHREE

SEQ ID NO: 26 - protein, 377 aa, Medicago sativa
  misc_feature (1)..(377): Public GI ID no. 145206861
  misc_feature (1)..(377): Medicago sativa subsp. caerulea
  misc_feature (213)..(309): Pfam Name: 2OG-FeII_Oxy Pfam Description: 2OG-Fe(II) oxygenase superfamily
  misc_feature (1)..(377): Bit score of 606.5 for HMM based on sequences of Figure 4
  misc_feature (1)..(377): Functional Homolog Of SEQ ID NO. 1
MPSLSEAYRAHPVHVNHKHPDFNSLQELPESYTWTHLDDHTLINSNNTMKESANSSSVPVIDLNDPNASKLIGHACKTWGVYQVVNHGIPISLLDEIQWLGQTLFTLPSHQKLKAIRSPDGVSGYGLARISSFFPKLMWSEGFTIVGSPLDHFRQLWPQDYAKHCDTVLQYDEAMKKLAGKLMWLMLDSLGITMEDIEWAGSKAQFDEKACAAMQLNSYPSCPDPDHAMGLAPHTDSTFLTILSQNDISGLQVQGEGSGWVTVPPLHGGLVVNVGDLFHILSNGLYTSVLHRVLVNRTRQRFSVAYLYGPPSNVEICPHEKLVGPTQPPLYRSVTWNEYLGTKAKHFNKALSSVSLCAPINGLFDVNDSNKSSVQVG

SEQ ID NO: 27 - protein, 356 aa, Solanum tuberosum
  misc_feature (1)..(356): Public GI ID no. 225421145
  misc_feature (1)..(356): Solanum tuberosum subsp. andigenum
  misc_feature (193)..(290): Pfam Name: 2OG-FeII_Oxy Pfam Description: 2OG-Fe(II) oxygenase superfamily
  misc_feature (1)..(356): Bit score of 576.6 for HMM based on sequences of Figure 4
  misc_feature (1)..(356): Functional Homolog Of SEQ ID NO. 1
MPSIISSEKQLDLYSIKELPESHAWRSSLDDDGSRNINVESIPVIDLNDDKFAIDRIGHACKTWGAFQIINHNISQRLLNDMETCGTRLFSLPMQQKLKAARSSDGIAGYGVARISSFFSKLMWSEGFTIFGSPLEHARQLWPHNYNKFCDVIEEYENEMEKLAGTLMGLMLGSLGITKEDVKWAVGPRSGCSALQLNSYPACPDPDRAMGLAAHTDSTILTILHQNNTSGLQVFREGNGWVTVPPLRGALVINVGDLLHILSNGLYPSVLHRAVVNRTRHRLSVAYLYGPPSGVKISPLSKLVDQRNPPMYRPVTWSEYLGTKAKHFDKALSSVRLCAPRIGFANSKDQSGVQVG

SEQ ID NO: 28 - protein, 346 aa, Cucurbita maxima
  misc_feature (1)..(346): Public GI ID no. 2289032
  misc_feature (201)..(299): Pfam Name: 2OG-FeII_Oxy Pfam Description: 2OG-Fe(II) oxygenase superfamily
  misc_feature (1)..(346): Bit score of 368.5 for HMM based on sequences of Figure 4
  misc_feature (1)..(346): Functional Homolog Of SEQ ID NO. 1
MDKLPAVGLLTPLDLNTVEAVPESHVWPHLDESSQKFKSDKTVSIPVVDFNDDNVLELIGKACEEWGMFQLINHGIPKTLTAETEEVARCLFALPKSQKMKTLNVPGTANGYCMARLTKHHDKMMWHEGFTVIGSPVDDFKKLWPSDYQPFCDKVEEYQLKMKALADKLISLIFKYLGISDEEMVKKLSYIDPATGKPHLALRLNSFPPCPEPSKVMGLAAHTDTSLFTMLHQARREGLQILNEKEGWLPLAPRRDALIINIGDFLQIISNGRFHSVPHRVMIRETEKTTMSMAYFFHPPGHLYVAPYCKPLSETLQTPIYKGVNVKEYFIIKAKASGKGIAALTI

SEQ ID NO: 29 - protein, 377 aa, Cucurbita maxima
  misc_feature (1)..(377): Public GI ID no. 27123661
  misc_feature (215)..(311): Pfam Name: 2OG-FeII_Oxy Pfam Description: 2OG-Fe(II) oxygenase superfamily
  misc_feature (1)..(377): Bit score of 528.7 for HMM based on sequences of Figure 4
  misc_feature (1)..(377): Functional Homolog Of SEQ ID NO. 1
MATTIADVFKSFPVHIPAHKNLDFDSLHELPDSYAWIQPDSFPSPTHKHHNSILDSDSDSVPLIDLSLPNAAALIGNAFRSWGAFQVINHGVPISLLQSIESSADTLFSLPPSHKLKAARTPDGISGYGLVRISSFFPKRMWSEGFTIVGSPLDHFRQLWPHDYHKHCEIVEEYDREMRSLCGRLMWLGLGELGITRDDMKWAGPDGDFKTSPAATQFNSYPVCPDPDRAMGLGPHTDTSLLTIVYQSNTRGLQVLREGKRWVTVEPVAGGLVVQVGDLLHILTNGLYPSALHQAVVNRTRKRLSVAYVFGPPESAEISPLKKLLGPTQPPLYRPVTWTEYLGKKAEHFNNALSTVRLCAPITGLLDVNDHSRVKVG

SEQ ID NO: 30 - protein, 381 aa, Hordeum vulgare
  misc_feature (1)..(381): Public GI ID no. 49065950
  misc_feature (1)..(381): Hordeum vulgare subsp. vulgare
  misc_feature (210)..(311): Pfam Name: 2OG-FeII_Oxy Pfam Description: 2OG-Fe(II) oxygenase superfamily
  misc_feature (1)..(381): Bit score of 497.8 for HMM based on sequences of Figure 4
  misc_feature (1)..(381): Functional Homolog Of SEQ ID NO. 1
MPSTPPSQLNKDPHNRYFDLGAAREVPDTHAWDGQHELPVVDGGVGAGDDAVPVVDMRDPRAAEAVARASEQWGAFLLEGHGVPTELLARVEAGIAGMFALPTPEKMRAARHDGDLYGYGPPLIASYVSKNMWSEGYTLTPANLHAEFRKIWPDAGQHYRHFSGVMEEFLKEMRSLANRLMELFLVALGLTAEQIAGVEAEHNLTESMTETMHLNWYPKCPDPTRALGLKGHTDSGFFTFVLQSQVPGLHLFRHGPPVDRWVEVPAVPGALIVNIGDLFQILTNGRFRSVYHRVVVNRERERISVAYFLIPPADVKVAPLKEVVGGGKPAYRALTWSESIVVRKEAFANHGADLEFGKGRTALDMLSISSDEDDGAEHHRD

SEQ ID NO: 31 - protein, 371 aa, Zea mays
  misc_feature (1)..(371): Public GI ID no. 226508364
  misc_feature (223)..(308): Pfam Name: 2OG-FeII_Oxy Pfam Description: 2OG-Fe(II) oxygenase superfamily
  misc_feature (1)..(371): Bit score of 483.1 for HMM based on sequences of Figure 4
  misc_feature (1)..(371): Functional Homolog Of SEQ ID NO. 1
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKARAGRRPGEPTATGYGRPPLALRFSKLMWSEGYTFRAATVREEFRRVWPDGGDDYLRFCDVMEEYDREMRALGGRLLDLFFMALGLTDVQFATGETERRIRETWTATMHPILCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 32 - protein, 355 aa, Frankia
  misc_feature (1)..(355): Public GI ID no. 312197436
  misc_feature (1)..(355): Frankia sp. EuI1c
  misc_feature (207)..(311): Pfam Name: 2OG-FeII_Oxy Pfam Description: 2OG-Fe(II) oxygenase superfamily
  misc_feature (1)..(355): Bit score of 79.9 for HMM based on sequences of Figure 4
  misc_feature (1)..(355): Functional Homolog Of SEQ ID NO. 1
MDDSGLPAPSAIFIEDRSTDGDTSAGVATVTVLDVAAAIGTGSAGVSAAGEAAVAERLVASFRHTGFAVITGHGVDLGLFERFCAESAAFFALPLAEKLEVGFPAPEVIRGYEPVPDDSGPVRAPNMMESLLINQLEPVDDYPDGSAQARLWRWPNLWPSRPASLRGVWEDYYRAMTALGDRLLELVALGVGLPKDWFADKFDRHFNNLAANHYPPRAGSVSGSPMLRNRPHTDHGALTLLYRPSEPGGLEVFAEGRWWQVPFVPGSLVINIGDMLERWTGGLLPATPHRVVNSADGAATGRSSVAYFQQPNPDALVAPALPVVAGRPDYSPVIAGEHISRKELGYHTVSAALDA

SEQ ID NO: 33 - protein, 381 aa, Oryza sativa
  misc_feature (1)..(381): Public GI ID no. 218196191
  misc_feature (1)..(381): Oryza sativa Indica Group
  misc_feature (229)..(324): Pfam Name: 2OG-FeII_Oxy Pfam Description: 2OG-Fe(II) oxygenase superfamily
  misc_feature (1)..(381): Bit score of 457.5 for HMM based on sequences of Figure 4
  misc_feature (1)..(381): Functional Homolog Of SEQ ID NO. 1
MQIMTSSSTSPTSPLAAAAHNGVAAAYFNFRGAERVPESHVWKGMHEKDTAPVAAADADGGDAVPVVDMSGGDDAAVAAVARAAEEWGGFLLVGHGVTAEALARVEAQAARLFALPADDKARGARRPGGGNTGYGVPPYLLRYPKQMWAEGYTFPPPAIRDEFRRVWPDAGDDYHRFCSAMEEYDSSMRALGERLLAMFFKALGLAGNDAPGGETERKIRETLTSTIHLNMFPRCPDPDRVVGLAAHTDSGFFTFILQSPVPGLQLLRHRPDRWVTVPGTPGALIVVVGDLFHVLTNGRFHSVFHRAVVNRERDRISMPYFLGPPADMKVTPLVAAGSPESKAVYQAVTWPEYMAVRDKLFGTNISALSMIRVAKEEDKES

SEQ ID NO: 34 - DNA, 1181 bp, Glycine max
  misc_feature (1)..(1181): Ceres Clone ID no. 1045013
  misc_feature (1)..(1181): Encodes the peptide sequence at SEQ ID NO. 35
aatttcatcttaataatgaacactctctctgaagcctacaaagcacaccctctccacctcagtcacattattcccttagacttttcttcagcccttagcttacctgattctcacgcatggcctcactgtcaacccaatgatgatgcatcatcatcatcatcatcatcatccatacccatcatagacctcatggatcccaatgctatggacctcataggccatgcatgtgagaagtggggtgctttccaattgaagaaccatggcataccttttggtgtcattgaagatgttgaagaagaggctaaaagactttttgctcttcccactgaacagaagttgaaggctcttcgatctcccggtggtgccactgggtatggcagagcaaggatttcaccgttcttcccaaagtttatgtggcacgaaggattcaccatcattggctctccctctcacgatgccaaaaagatatggcctaatgattatgcacgcttttgtgatttgatggagaattatgagaagcaaatgaaggttctagcggatagactaacagagatgatattcaacttaatggacataagtgaggaaaaaagaaagtgggttggtgcaagcaacataagtgaagctgttcagttaaatttctacccaagttgtcccgagccaaaccgagccatgggcttagcccctcacaccgacacttctctcttcacaattcttcaccaaagtcaaatcactggtcttcaaatcttcaaggaaggaaaagggtgggttcctgtgcaccctcaccctaataccctggtcgtgcacacaggcgatctcttgcacatcatttccaacgcaaggtttcgctgtgcacttcaccgcgtaacggtgaataggacatgggaacgttactctgtggcttatttctattctccaccgatggattatgtagtttctcctttggttcactctgttgctcgttttcgtgatgtgactgtgaaggagtatattgggattaaggctaagaattttggagaagcattgtcctttattagtacttgaaactatgtatgtatcttatgattttgttatatgtattaattccttaaatatttatctagctagatactttattaatttgcttctttgtaaatttcccatttctgttagttgttaggaagtgctagatatatatcagactt

SEQ ID NO: 35 - protein, 341 aa, Glycine max
  misc_feature (1)..(341): Ceres Clone ID no. 1045013
  misc_feature (202)..(300): Pfam Name: 2OG-FeII_Oxy Pfam Description: 2OG-Fe(II) oxygenase superfamily
  misc_feature (1)..(341): Bit score of 435.3 for HMM based on sequences of Figure 4
  misc_feature (1)..(341): Functional Homolog Of SEQ ID NO. 1
MNTLSEAYKAHPLHLSHIIPLDFSSALSLPDSHAWPHCQPNDDASSSSSSSSIPIIDLMDPNAMDLIGHACEKWGAFQLKNHGIPFGVIEDVEEEAKRLFALPTEQKLKALRSPGGATGYGRARISPFFPKFMWHEGFTIIGSPSHDAKKIWPNDYARFCDLMENYEKQMKVLADRLTEMIFNLMDISEEKRKWVGASNISEAVQLNFYPSCPEPNRAMGLAPHTDTSLFTILHQSQITGLQIFKEGKGWVPVHPHPNTLVVHTGDLLHIISNARFRCALHRVTVNRTWERYSVAYFYSPPMDYVVSPLVHSVARFRDVTVKEYIGIKAKNFGEALSFIST

SEQ ID NO: 36 - protein, 360 aa, Nicotiana tabacum
  misc_feature (1)..(360): Public GI ID no. 134303282
  misc_feature (197)..(294): Pfam Name: 2OG-FeII_Oxy Pfam Description: 2OG-Fe(II) oxygenase superfamily
  misc_feature (1)..(360): Bit score of 582.4 for HMM based on sequences of Figure 4
  misc_feature (1)..(360): Functional Homolog Of SEQ ID NO. 1
MPSRISDDVHQKQLDLYTIKELPESHAWRSSLDHDYQCNDSLESIPVIDLNDEKFAIENIGHACKTWGAFQIINHNISQRLLDNMEEAGKRLFSLPMQQKLKAARSADGIAGYGVARISSFFSKLMWSEGFTIVGSPFDHARQLWPHDYKKFCDVIEEYEKEMEKLAGRLMWLMLGSLGISKDDMKWACCGPRGECSALQLNSYPACPDPDRAMGLAAHTDSTILTILHQNNTSGLQVFKEGNGWVTVPPLSGALVINVGDLLHILSNGLYPSVLHRAVVNRTRHRLSVAYLYGPPSGVKISPLSKLVDQGHPPLYRSVTWSEYLGTKAKHFDKALSSFQLCAPRIGFANPKDRNSVQVG

SEQ ID NO: 37 - protein, 379 aa, Oryza sativa
  misc_feature (1)..(379): Public GI ID no. 14780049
  misc_feature (1)..(379): Oryza sativa Indica Group
  misc_feature (226)..(322): Pfam Name: 2OG-FeII_Oxy Pfam Description: 2OG-Fe(II) oxygenase superfamily
  misc_feature (1)..(379): Bit score of 453.2 for HMM based on sequences of Figure 4
  misc_feature (1)..(379): Functional Homolog Of SEQ ID NO. 1
MTSSSTSPTSPLAAAAHNGVTAAYFNFRGAERVPESHVWKGMHEKDTAPVAAADADGGDAVPVVDMSGGDDAAVAAVARAAEEWGGFLLVGHGVTAEALARVEAQAARLFALPADDKARGARRPGGGNTGYGVPPYLLRYPKQMWAEGYTFPPPAIRDEFRRVWPDAGDDYHRFCSAMEEYDSSMRALGERLLAMFFKALGLAGNDAPGGETERKIRETLTSSTIHLNMFPRCPDPDRVVGLAAHTDSGFFTFILQSPVPGLQLLRHRPDRWVTVPGTPGALIVVVGDLFHVLTNGRFHSVFHRAVVNRERDRISMPYFLGPPADMKVTPLVAAGSPESKAVYQAVTWPEYMAVRDKLFGTNISALSMIRVAKEEDKES

SEQ ID NO: 38 - protein, 364 aa, Gossypium hirsutum
  misc_feature (1)..(364): Public GI ID no. 340796369
  misc_feature (201)..(297): Pfam Name: 2OG-FeII_Oxy Pfam Description: 2OG-Fe(II) oxygenase superfamily
  misc_feature (1)..(364): Bit score of 576.4 for HMM based on sequences of Figure 4
  misc_feature (1)..(364): Functional Homolog Of SEQ ID NO. 1
MPSRLSDAIIRLHPDFTSLQELPESYAWNQRDDIDYPSFDSSAESVPIIDLNDPNALQNIGHACRTWGVFQVINHGVSTTLLDMVESTSRTLFSLPVNQKLKAARSPDGVSGYGFARISSFFSKLMWSEGFTIVGSPDEHFRQLWPHDYTNHCDVIKEYKQEMKKLAGRLMCLMLGSLGITAKQDIKWAGPKSEFKEASAALQLNYYPACPDPDRAMGLAAHTDSTLLTILYQNSTSGLQVLKEGVGWIKVSPVPDGLVINVGDLMHILSNGSYPSVLHRAMVNRTRHRLSIAYLYGPPSSVKISPHPKLVGPTHPPLYRPITWNEYLDTKAKYFNKALSWVRVCVPLNGLVDVNEHNNSVKVG

SEQ ID NO: 39 - protein, 362 aa, Lactuca sativa
  misc_feature (1)..(362): Public GI ID no. 4164147
  misc_feature (197)..(292): Pfam Name: 2OG-FeII_Oxy Pfam Description: 2OG-Fe(II) oxygenase superfamily
  misc_feature (1)..(362): Bit score of 548.6 for HMM based on sequences of Figure 4
  misc_feature (1)..(362): Functional Homolog Of SEQ ID NO. 1
MSLQQLDAFREKHLDLNSIKELPESYAWSSEDNCPSSSNSEPVPVINLKDSNAMKHVGYACKTWGVFQVTNHDIPITLLNNMEASGRKLFSLPFQQKLKAARSLDGVSGYGVARISSFFPKLMWSEGFTLIDSPHQHAQKLWPQGSGNFCDVIEEYNKEMNKLSNRVMWLILGSLGIKKGDIKWANQEGEIKEACAALQLNSYPSCPDPDRAMGLAAHTDSTLLTILHQSNTSGLQVQRGVGWVTVKPIAGALVVNIGDLIQILSNGLYSSVLHRAMVNRTQHRLSVAYLYGPPSNVRIAPLSKLTDNVHPPLYRPVTWSEYLGTKAKHFNKALLFVRLCAPITMSGFVDASTDNHNSVLVG

SEQ ID NO: 40 - protein, 345 aa, Lactuca sativa
  misc_feature (1)..(345): Public GI ID no. 9971221
  misc_feature (206)..(303): Pfam Name: 2OG-FeII_Oxy Pfam Description: 2OG-Fe(II) oxygenase superfamily
  misc_feature (1)..(345): Bit score of 421.0 for HMM based on sequences of Figure 4
  misc_feature (1)..(345): Functional Homolog Of SEQ ID NO. 1
MNTLSKAYEVGTTFSHNIIPLDFESIDGVPESHLWSQSDESHQKIQTNNPRDSLIPVIDLYDPCAIDLIGQACKTWGMFQVINHGVPLELVKKVEFEARRLFSLTTHEKRKVLRSATGATGYGLPRISPFFAKCMWHEGFTIMGSCVDDAKVLWPHDYQRFCDTMDDYQNQMKLLAHKLLLLSLQTLDVTQEEINWATSTHGSNGALQLNSYPSCPNPSRTLGLAPHTDSLLLTILNQYGITGLEIFVEGLGWSPVCPIEGAFVVNVGDLLHIFSNAKFPVVYHRAVVNQSKHRISVAYFYGPPIESTLAPLSNYQDPCFRSLLVKEYIRLKATHNDKALSLIRI

SEQ ID NO: 41 - protein, 347 aa, Arabidopsis thaliana
  misc_feature (1)..(347): Public GI ID no. 3982753
  misc_feature (204)..(298): Pfam Name: 2OG-FeII_Oxy Pfam Description: 2OG-Fe(II) oxygenase superfamily
  misc_feature (1)..(347): Bit score of 484.0 for HMM based on sequences of Figure 4
  misc_feature (1)..(347): Functional Homolog Of SEQ ID NO. 1
MSSTLSDVFRSHPIHIPLSNPPDFKSLPDSYTWTPKDDLLFSASASDETLPLIDLSDIHVATLVGHACTTWGAFQITNHGVPSRLLDDIEFLTGSLFRLPVQRKLKAARSENGVSGYGVARIASFFNKKMWSEGFTVIGSPLHDFRKLWPSHHLKYCEIIEEYEEHMQKLAAKLMWFALGSLGVEEKDIQWAGPNSDFQGTQAAIQLNHYPKCPEPDRAMGLAAHTDSTLMTILYQNNTAGLQVFRDDVGWVTAPPVPGSLVVNVGDLLHILTNGIFPSVLHRARVNHVRSRFSMAYLWGPPSDVMISPLPKLVDPLQSPLYPSLTWKQYLATKATHFNQSLSIIRN

SEQ ID NO: 42 - protein, 370 aa, Triticum aestivum
  misc_feature (1)..(370): Public GI ID no. 85540947
  misc_feature (209)..(306): Pfam Name: 2OG-FeII_Oxy Pfam Description: 2OG-Fe(II) oxygenase superfamily
  misc_feature (1)..(370): Bit score of 600.0 for HMM based on sequences of Figure 4
  misc_feature (1)..(370): Functional Homolog Of SEQ ID NO. 1
MPTPAHLSKDPRYFDFRAARRVPETHAWPGLHDHPVVDGSGAGGGPDAVPVVDMRDPCAAEAVALAAQDWGAFLLEGHGVPLELLARVEAAIAGMFALPASEKMRAVRRPGDSCGYGSPPISSFFSKCMWSEGYTFSPANLRSDLRKLWPKAGHDYRHFCAVMEEFHREMRALADKLLELFLVALGLTGEQVAAVESEQKIAETMTATMHLNWYPKCPDPKRALGLIAHTDSGFFTFVLQSLVPGLQLFRHGPDRWVTVPAVPGAMVVNVGDLFQILTNGRFHSVYHRAVVNRDSDRISLGYFLGPPAHVKVAPLREALAGTPAAYRAVTWPEYMGVRKKAFTTGASALKMVAISTDNDAANHTDDLISS

SEQ ID NO: 43 - DNA, 1215 bp, Sorghum bicolor
  misc_feature (1)..(1215): Ceres Annot ID no. 8725416
  misc_feature (1)..(1215): Encodes the peptide sequence at SEQ ID NO. 44
atgccgtcgtcgtcgtcgtcagcctcgacgccggccgccgcatccggcggcctcttcgagttggggtccgcggcgagcgtgccggagacgcacgcgtggccgggggtgaacgagcacccgtcggtggagtccgctggccgcgacgcggtcccggtggtggacatgggcatgggcggcccggacgacgccgacgcggcggcgcgggcagtggcgcgcgccgccgaggagtggggcgcgttcctgctcgtcggccacggcgtgccgcggggcgtggcggcgcgcgccgaggcgcaggtcgcgcgcctgttcgcgctcccggctcccgacaaggcccgcgctgcccgtcgccgccgtgccgccgccgccgccgccgccggctacggcatgccgcccctggcgctccgcttctccaagctcatgtggtccgaggcgtacacgttccccgccgccgccgtccgcgacgagttccgccgcgtctggcccgacgccggcgacgactacctccgcttctgcgacgtgatggaggagtacgacagagagatgagggctctcggcggcaggctgctcgacctattcttcatggcgctcggcggcggcctcaccgacgacgaccagatcgccggcggcgagacgacgacgacggagcggaagatccgagacaacttgacggcgatgatgcacccgatcctgtaccccaagtgcccggaaccggagcgcgccatggggctggcgccgcacacggactcgggcttcatcacgctcatcacgcagagcgccggcgtgccggggctgcagctgctccgccgcgggccggacaggtgggtgacggtgccggcgccgccgggcgcgttcgtcgtcgtgctcggcgacctcttccaggtgctcaccaacggccgctaccggagcgcgctccaccgcgccgtcgtgaacagggagcgcgaccggatctccgtgccctacttcctcggcccgccggacggcatgaaggtggcgccgctcgcgtcggctctgctgccggggaggaggaaggccgcgttccgggccgtgacgtggccggagtacatggagctcaagcacaaggtgctcggcacggatacgtcggcgctggagatgctgcagttggacgaggaagagatggtgggagggggcccgccacctaagaaactattccttcggttcaaaacgaaaggaattttgtcttttctacataattag

SEQ ID NO: 44 - protein, 404 aa, Sorghum bicolor
  misc_feature (1)..(404): Ceres Annot ID no. 8725416
  misc_feature (231)..(324): Pfam Name: 2OG-FeII_Oxy Pfam Description: 2OG-Fe(II) oxygenase superfamily
  misc_feature (1)..(404): Bit score of 457.2 for HMM based on sequences of Figure 4
  misc_feature (1)..(404): Functional Homolog Of SEQ ID NO. 1
MPSSSSSASTPAAASGGLFELGSAASVPETHAWPGVNEHPSVESAGRDAVPVVDMGMGGPDDADAAARAVARAAEEWGAFLLVGHGVPRGVAARAEAQVARLFALPAPDKARAARRRRAAAAAAAGYGMPPLALRFSKLMWSEAYTFPAAAVRDEFRRVWPDAGDDYLRFCDVMEEYDREMRALGGRLLDLFFMALGGGLTDDDQIAGGETTTTERKIRDNLTAMMHPILYPKCPEPERAMGLAPHTDSGFITLITQSAGVPGLQLLRRGPDRWVTVPAPPGAFVVVLGDLFQVLTNGRYRSALHRAVVNRERDRISVPYFLGPPDGMKVAPLASALLPGRRKAAFRAVTWPEYMELKHKVLGTDTSALEMLQLDEEEMVGGGPPPKKLFLRFKTKGILSFLHN

SEQ ID NO: 45 - protein, 344 aa, Daucus carota
  misc_feature (1)..(344): Public GI ID no. 50428333
  misc_feature (204)..(302): Pfam Name: 2OG-FeII_Oxy Pfam Description: 2OG-Fe(II) oxygenase superfamily
  misc_feature (1)..(344): Bit score of 431.6 for HMM based on sequences of Figure 4
  misc_feature (1)..(344): Functional Homolog Of SEQ ID NO. 1
MSNLSEAYRDTPVHLHHIIPLDFHAVDSVPESHEWPHSDVLRPVIDEISIPLVDLKDPNAQKLIGHASEDWGIFQVTNHGVPLGVLMDVEFEARRLFSLPVKEKLKVLRSPEGATGYGAARISPFFSKFMWHEGFTIIGSSSVDHAKQLWPHDYESFTDVIDVYQKKMKELAHQILLLLLKSLEISEEDITSWAASTHDSNNGALQLNSYPCCPNPSRAIGLAPHTDSLLLTILSQTHDSSALQIFRDGVGWIAVAPVRDALVVNVGDLLHILSNGRFPSVYHQVIVSEKEHRISVAYFYGPRTDAQVAPLSRIEVPIYRSLSVKEFIGIKAKHLDKALSFVRI

SEQ ID NO: 46 - protein, 353 aa, Daucus carota
  misc_feature (1)..(353): Public GI ID no. 50428331
  misc_feature (210)..(306): Pfam Name: 2OG-FeII_Oxy Pfam Description: 2OG-Fe(II) oxygenase superfamily
  misc_feature (1)..(353): Bit score of 526.9 for HMM based on sequences of Figure 4
  misc_feature (1)..(353): Functional Homolog Of SEQ ID NO. 1
MPSRVSDSLALHPVFQHNHNQYLDLNSLEELPDSHAWSSELDKLSSSPDDHGESNLPVIDLSDSINGPKHLVHACKTWGAFQLINHGISNQLIDSMEAATRKLFSLPIEQKLKAERQEGGCGYGPFRISSFFPKRMWSEGFTIVGSPLQHARLLWPEDYSVFCDVTEEYQKEMKKLAGKIMWIMLEALGITKEDIIWAGPNGEFEASGAALQLNSYPVCPDPDRAMGLADHTDSTLLSILHQSNQSGLQVFQEEMGWVTVPPVEGALVVNIGDLLHILTNGSYPSVLHRVTVNRERHRYSMAYLYGPPHSAEISPLSKLVDHQHPPLYRPVTWSEYLGMKAILFYNALSSLRL

SEQ ID NO: 47 - protein, 368 aa, Gossypium hirsutum
  misc_feature (1)..(368): Public GI ID no. 340796371
  misc_feature (205)..(301): Pfam Name: 2OG-FeII_Oxy Pfam Description: 2OG-Fe(II) oxygenase superfamily
  misc_feature (1)..(368): Bit score of 570.0 for HMM based on sequences of Figure 4
  misc_feature (1)..(368): Functional Homolog Of SEQ ID NO. 1
MPSRLSDAFRAHPQQQLKHPDFTSLHELPDSYAWNQRDDPSPETFATESVPLVDLNDSNALQVIGHACKTWGIFQVTNHGISTSLLDMVEHTCRSLFSLPVHQKLKAARSPDGVSGYGFARISSFFSKLMWSQGFTIVGPPDEHFCQLWPQDFSYHCDVIKEYKEEMKKLAGRLMWLMLGSLGIIAKEDIKWAGPKADFKGASAALQLNYYPACPDPDRAMGLAPHTDSTLLTILYQNSTSGLQVFKEGAGWVAVPPVPGGLVINVGDLMHILSNGSYQSVLHRAMVNRSHHRLSSAYLYGPPSTVEISPHPKLVGPTHPPLYRPVTWNEYLHTKAKHFNKALSSVRVCVPLNGLGDVNEQNNSVTVG

SEQ ID NO: 48 - protein, 380 aa, Zea mays
  misc_feature (1)..(380): Public GI ID no. 219887767
  misc_feature (225)..(317): Pfam Name: 2OG-FeII_Oxy Pfam Description: 2OG-Fe(II) oxygenase superfamily
  misc_feature (1)..(380): Bit score of 484.6 for HMM based on sequences of Figure 4
  misc_feature (1)..(380): Functional Homolog Of SEQ ID NO. 1
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKARAGRRPGEPTATGYGRPPLALRFSKLMWSEGYTFRAATVREEFRRVWPDGGDDYLRFWCMRAPSDVMEEYDREMRALGGRLLDLFFMALGLTDVQFATGETERRIRETWTATMHPILYPRCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 49 - protein, 355 aa, Solanum tuberosum
  misc_feature (1)..(355): Public GI ID no. 15418962
  misc_feature (192)..(289): Pfam Name: 2OG-FeII_Oxy Pfam Description: 2OG-Fe(II) oxygenase superfamily
  misc_feature (1)..(355): Bit score of 559.4 for HMM based on sequences of Figure 4
  misc_feature (1)..(355): Functional Homolog Of SEQ ID NO. 1
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVLPLRGALVLNVGDLVHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 50 - protein, 382 aa, Torenia fournieri
  misc_feature (1)..(382): Public GI ID no. 320462776
  misc_feature (214)..(311): Pfam Name: 2OG-FeII_Oxy Pfam Description: 2OG-Fe(II) oxygenase superfamily
  misc_feature (1)..(382): Bit score of 574.0 for HMM based on sequences of Figure 4
  misc_feature (1)..(382): Functional Homolog Of SEQ ID NO. 1
MPSMASSVILPDASFKSQPPLNVHKKYLDLSSVKELPETHAWTSSKLDDEETCDAENVPIIDLNDENAIELIGRACRTWGVFQVINHNIPKSLLDEIEFEGKKLFSLPMQQKLRAARSPDGVSGYGVARISSFFSKLMWSEGFTILGSVSEHARLLWPNDYNKFCDTIEEYQKAMKRLAGRLMWLMLGSLGITEDDDLKWAAQKEPDDQGGSAALQLNSYPSCPDPDRAMGLAAHTDSTILTILHQSNTSGLQVAREGRAGWVTVPPLAGALVVHVGDLLHILSNGLYPSVVHRAVVNRTRHRLSVAYLYGPPSSVKISPLRKLVDKYHPPLYRPITWSEYLGTKAKHFDKALTSVRLLCAPRNGFVDTSNDHTSSTVQLVG

SEQ ID NO: 51 - protein, 355 aa, Vitis vinifera
  misc_feature (1)..(355): Public GI ID no. 225430186
  misc_feature (208)..(306): Pfam Name: 2OG-FeII_Oxy Pfam Description: 2OG-Fe(II) oxygenase superfamily
  misc_feature (1)..(355): Bit score of 473.5 for HMM based on sequences of Figure 4
  misc_feature (1)..(355): Functional Homolog Of SEQ ID NO. 1
MASTLSQVFRDNPLPLNHIIPLDFTSVHSLPESHVWPAFDGFPFGTTYPGEKFSIPIIDLMDPNAAQLVGHACEKWGAFQLTSHGLPSILTDDVESQTRRLFALPAHEKMKALRLPSGGTGYGQARISPFYPKFMWHEGFTIMGSAVDHARKLWPDDYKGFCDVMEDYQKKMKELAESLLHIFLESLDISKEEYRSTTIQRGREACNTALQLNSYPPCPDPNRAMGLAPHTDSLLFTIVHQSHTSGLQILRDGVGWITVFPLEGALVVNVGDLLHILSNGRYPSVLHRAVVNQAEHRISLAYFYGPPADSLISPLCNLVSSGQQVVAPRYRSVSVKEYVDLKEKHKEKALSLLRL

SEQ ID NO: 52 - protein, 374 aa, Pisum sativum
  misc_feature (1)..(374): Public GI ID no. 2314805
  misc_feature (210)..(306): Pfam Name: 2OG-FeII_Oxy Pfam Description: 2OG-Fe(II) oxygenase superfamily
  misc_feature (1)..(374): Bit score of 606.8 for HMM based on sequences of Figure 4
  misc_feature (1)..(374): Functional Homolog Of SEQ ID NO. 1
MPSLSEAYRAHPVHVNHKHPDFNSLQELPESYNWTHLDDHTLIDSNNIMKESTTTVPVIDLNDPNASKLIGLACKTWGVYQVMNHGIPLSLLEDIQWLGQTLFSLPSHQKHKATRSPDGVSGYGIARISSFFPKLMWYEGFTIVGSPLDHFRELWPQDYTRFCDIVVQYDETMKKLAGTLMCLMLDSLGITKEDIKWAGSKAQFEKACAALQLNSYPSCPDPDHAMGLAPHTDSTFLTILSQNDISGLQVNREGSGWITVPPLQGGLVVNVGDLFHILSNGLYPSVLHRVLVNRTRQRFSVAYLYGPPSNVEICPHAKLIGPTKPPLYRSVTWNEYLGTKAKHFNKALSSVRLCTPINGLFDVNDSNKNSVQVG

SEQ ID NO: 53 - protein, 373 aa, Populus trichocarpa
  misc_feature (1)..(373): Public GI ID no. 224070877
  misc_feature (1)..(373): Ceres Annot ID no. 1446477
  misc_feature (211)..(307): Pfam Name: 2OG-FeII_Oxy Pfam Description: 2OG-Fe(II) oxygenase superfamily
  misc_feature (1)..(373): Bit score of 595.3 for HMM based on sequences of Figure 4
  misc_feature (1)..(373): Functional Homolog Of SEQ ID NO. 1
MPSRSLTDAFRSHPVHLHQKHLDFSSLQEIPDSHKWTQLDDIEQQHPSVESFITESVPVIDLLDPNVLQNIGNACKTWGVLQVTNHGIPISLLESVEGVSRSLFSLPVQQKLKAARSPDGVSGYGVARISSFFSKLMWSEGFTIVGSPLEHFRQLWPQDYTKFCDVIEEHEKEMQKLARRLTWLMLGSLGITKKDLNWAGPKGESKEGGAALQLNSYPACPDPDLAMGLAAHTDSTLLTILYQNNTSGLQVLKEGIGWVTVPPIPGGLVVNVGDLLHILSNGLYPSVLHRAVVNRTKHRLSIAYLYGPPSSVQISPIQKLVGPNHPPLYRPITWNEYLVAKAKHFNKALSSVRICAPLNGLVDVNDHNSVKVG

SEQ ID NO: 54 - protein, 344 aa, Daucus carota
  misc_feature (1)..(344): Public GI ID no. 50428329
  misc_feature (193)..(290): Pfam Name: 2OG-FeII_Oxy Pfam Description: 2OG-Fe(II) oxygenase superfamily
  misc_feature (1)..(344): Bit score of 495.2 for HMM based on sequences of Figure 4
  misc_feature (1)..(344): Functional Homolog Of SEQ ID NO. 1
MLTEESYQTQYLDLNSIKELPESHTWTSLQDDCTDCLSNESESLPIIDLNDPDVLALVRHACETWGVLQVKNHGVSLRLLEDMEAATTKLFSLPIEQKLKVSLSSSNDISGYRLPKISPFFPKFMWREGFTIFGSPVEHAVKLWPQDYKPFCDLVEEYGKEMKNLAERLMWLMLKSLGITEEDINWSSLGGAAIQLNSYPVCPDPDRAMGLAEHTDSSLLTILYQNNTTGLQIFREGTGWLTVQPHTGVLVVNIGDLMHILSNGLYPSVLHRALVNRKQQRISVAYIYRPPANVLISPLPKLVDHYHLCLFRPITWTEYLELKSKHFTNTLSLIRISGSPNVVS

SEQ ID NO: 55 - protein, 365 aa, Vitis vinifera
  misc_feature (1)..(365): Public GI ID no. 297743334
  misc_feature (203)..(299): Pfam Name: 2OG-FeII_Oxy Pfam Description: 2OG-Fe(II) oxygenase superfamily
  misc_feature (1)..(365): Bit score of 610.8 for HMM based on sequences of Figure 4
  misc_feature (1)..(365): Functional Homolog Of SEQ ID NO. 1
MPSRISDAFKAHPLHLNHRHLDLNSVQELPDLYAWAGVDENPSGDSLITESVPVIDLTDPNASELVGHACKSWGVFQVTNHGIPGSLLDDIESAGRSLFSLPAQQKLKAARSPDGVAGYGLARISSFFNKLMWYEGFTIFGSPLEHARQLWPQDYTKFCDVTEEFEKEMNQLAERLMWLMLGSLGITKEDLNWAGSKGDFKAALQLNSYPACPEPDRAMGLAAHTDSSLFTILYQNTVSGLQVQREGAGWITVPPLPGALVINVGDLLHILSNGVFPSVVHRALVNRTKHRLSVAYLYGPPAGVPISPVPKLVDSTHPPLYRPVTWSEYLCTKAKHFDKALSLVRLCMPRNGFIDVNDHNGVKVG

SEQ ID NO: 56 - protein, 358 aa, Cucurbita maxima
  misc_feature (1)..(358): Public GI ID no. 8247213
  misc_feature (205)..(300): Pfam Name: 2OG-FeII_Oxy Pfam Description: 2OG-Fe(II) oxygenase superfamily
  misc_feature (1)..(358): Bit score of 464.9 for HMM based on sequences of Figure 4
  misc_feature (1)..(358): Functional Homolog Of SEQ ID NO. 1
MATTQTHHSVHITHKDHDLDSLQVLPDSYQWVQPDLFPSLQQHSTPLSDTLPLIDLSLPDAPDLIGKALRTWGSFQIINHGVPLSLIHAAQSSAIDLFALPTPYKLKASRTPGTFPGYGIARINSFFPKRMWSESFTIMGSPLEHFRHLWPHDYSKRCDIMAEYDRELKSLCGRLMWIALSELGITREDINWAGPNEDFKTCNAATQLNFYPACPDPDRAMGLGAHTDTTLLTVLHQNNTRGLQILREGRQWVTVEPVAGALVVQVGDMLQIVSNGLYKSPFHQAVVNRTQKRLSVAYLFVPPENVEMSPHKKLLNPTQPPLYRPISWTDFIRIKSNNFDGLSCIRVDVKDEKQVKVG

SEQ ID NO: 57 - protein, 369 aa, Malus x domestica
  misc_feature (1)..(369): Public GI ID no. 255040357
  misc_feature (209)..(305): Pfam Name: 2OG-FeII_Oxy Pfam Description: 2OG-Fe(II) oxygenase superfamily
  misc_feature (1)..(369): Bit score of 615.5 for HMM based on sequences of Figure 4
  misc_feature (1)..(369): Functional Homolog Of SEQ ID NO. 1
MHLKLSDAFKSHPVNLQLKHPDFNSLHELPDSYAWTNNDDHYPSFLTSFGADDSVPVINLSDTNVLKLTGHACKTWGVFQVTNHGIQQKLLDDIESAGKSLFSLPVQQKLKAARSPDGISGYGFARISSFFKKLMWSEGFTIVGSPVDHFRQLWPQDYDKFCNIIEEYEKEMKMLAGRLMWLMLGSLGISMEDIKWAGSKGEFKGASAALQLNSYPACPEPDRAMGLAAHTDSTLLTILYQSNTSGLQVLREGTGWVTVPPMPGALVINVGDLFHILSNGLYPSVLHRAVVNRTQHRLSVAYLFGPPASIQISPLSKLVGPSHPPLYRPISWNEYLGTKAKHFNKALSSVRLCAPLNSLVDVNDHNSVK

SEQ ID NO: 58 - protein, 355 aa, Arabidopsis lyrata
  misc_feature (1)..(355): Public GI ID no. 297839907
  misc_feature (1)..(355): Arabidopsis lyrata subsp. lyrata
  misc_feature (204)..(298): Pfam Name: 2OG-FeII_Oxy Pfam Description: 2OG-Fe(II) oxygenase superfamily
  misc_feature (1)..(355): Bit score of 478.1 for HMM based on sequences of Figure 4
  misc_feature (1)..(355): Functional Homolog Of SEQ ID NO. 1
MSSTLSDVFRSHPIHIPLSNLPDFKALPDSYTWTPKDDLLFSASASDETLPLIDLSDPHVTTLVGHACTTWGALQISNHGVPSRLLDDIEFLTGSLFRLNVQRKLKAARSENGVSGYGVARIASFFNKKMWSEGFTVIGSPLQDFRKLWPSHHLKYCEIIEEYGEHMQKLAAKLMWLALGSLGVEEKDIKWAGPNSDFQGTQAATQLNHYPICPEPDRAMGLAAHTDSTLMTILYQNNTAGLQVFRDDVGWVTVPPVPGSLVVNVGDLLHILTNGIFPSVLHRARVNHVRSRFSMAYLWGPPSDIMISPLPRLVDPLQSPLYPSLTWKQYLATKATHFNQSLSIIKNYLSSDQIS

SEQ ID NO: 59 - protein, 349 aa, Citrullus lanatus
  misc_feature (1)..(349): Public GI ID no. 8894936
  misc_feature (1)..(349): Citrullus lanatus subsp. vulgaris
  misc_feature (204)..(302): Pfam Name: 2OG-FeII_Oxy Pfam Description: 2OG-Fe(II) oxygenase superfamily
  misc_feature (1)..(349): Bit score of 407.2 for HMM based on sequences of Figure 4
  misc_feature (1)..(349): Functional Homolog Of SEQ ID NO. 1
MADQELPPPSQLVPLDFNSIQTVPESHLWPNSIELSPAIKLDERISLPIIDFLDDGASELLGRACEQWGMFQLINHGVPKTLIDEAEEETRRLFSLPARQKMKTLRTDSLTATGYGMAGISKYHQKLMWHEGFTMSGSPVDDAKKLWPNDYKRFCDVMEEYQSQMKGLGERIIRLIFKFLDISEEEMMKLLTSTDESAGKPYMALRLNSYPPCPDPSRVMGLAAHTDTSLFTIVHQARHDGLQVFKDGTGWVPLSPMSGTLIVNVGDILHILSNGRFPSILHRVMIHENKEHRFSLAYFYDPPGDLYISPYCKPLSESPQIPLYRCVNVKEYFTIKAKKEGKGLSAIKI

SEQ ID NO: 60 - protein, 349 aa, Pisum sativum
  misc_feature (1)..(349): Public GI ID no. 114329242
  misc_feature (202)..(300): Pfam Name: 2OG-FeII_Oxy Pfam Description: 2OG-Fe(II) oxygenase superfamily
  misc_feature (1)..(349): Bit score of 438.4 for HMM based on sequences of Figure 4
  misc_feature (1)..(349): Functional Homolog Of SEQ ID NO. 1
MATTLSEAYRDHPLHLHHIIPLDFSSFRTLPDSHAWPQSKDDNDHLTSNGSCIPIIDLNDPNAMEQIGLACEKWGAFQLKNHGVPLNLIEEVEEEAKKLFSLPSKEKIKALRSAGGATGYGRARISPFFPKYMWHEGFTIMGSPSNDVKKIWPNDYEYFCDIMEDYQKQMKTLAEKITNIIFNILGISKEQNKWVGSNNHCEALQLNFYPCCPDPKKAMGLAPHTDTSLFTILHQSQTSGLQIFKEGVGYVTVDPHPNTLVVNTGDILHILSNSRFRCSLHRAVVNDVKDRYSVAYFYGPPVDYLVSPLVVDGSLPRFRSLSVKDYIGIKAKNLGGALSLISTLLDHDD

SEQ ID NO: 61 - protein, 354 aa, Marah macrocarpus
  misc_feature (1)..(354): Public GI ID no. 304636271
  misc_feature (205)..(303): Pfam Name: 2OG-FeII_Oxy Pfam Description: 2OG-Fe(II) oxygenase superfamily
  misc_feature (1)..(354): Bit score of 393.6 for HMM based on sequences of Figure 4
  misc_feature (1)..(354): Functional Homolog Of SEQ ID NO. 1
MADQEITTAPPSSPLVPLDFSSSHETVPESHIWVDSIELSPAMDLDEKLSLPVIDLLDDTTASELIGKACQQWGMFQLINHGVPKSIIAETEDEARRLFALPTTQKMKTFGPGNTGYGMVPLSKYHSKSMWHEGFTIFGSPLDDAKKLWPSDYKRFCDVMEEYQRKMKGLADRLMRLILKFLDISEEEIMKLMFTPEDSSKIYTALRLNLYPPCPDPDRVVGMASHTDTSFFTIIHQARNDGLQIFKDEAGWVPLSPTSGTLMVNVGDLLQILSNGRFPSILHRVMIQEKMEDRLSLAYFYTPPPHIYIAPYCKPLSESPQIPLYRCVTVKEYSTSKSNNNFKGLSTVKISSLI

SEQ ID NO: 62 - protein, 363 aa, Lactuca sativa
  misc_feature (1)..(363): Public GI ID no. 4164145
  misc_feature (201)..(297): Pfam Name: 2OG-FeII_Oxy Pfam Description: 2OG-Fe(II) oxygenase superfamily
  misc_feature (1)..(363): Bit score of 595.9 for HMM based on sequences of Figure 4
  misc_feature (1)..(363): Functional Homolog Of SEQ ID NO. 1
MHTRVADAFKAHPMVNQKHLDLKSMKELPESHAWLSQDGSPSYGSSSSEQVPVINLKDPNAMKLVGHACKTWGVFQVTNHGVPTNLLEEMEAAGRKLFALPIQQKLKAARAPDGVSGYGVARISSFFPKLMWSEGFTIIGSPYEHARKLWPNRYSRFCDVIEGYKHEMNNLAQRLMWLMLGSLGVTTEDVKWDGSQGSCPALQLNSYPACPDPDRAMGLAAHTDSTLLTILYQNNTSGLQAHREGAGWVTVPPIPGALVVNVGDLLHILSNGLYPSVLHRAMVNRTQHRLSVAYLYGPPSNVQISPLSKLTDHVHPPLYRPVTWSEYLGTKAKHFNKALSSVRLCVPLNGFVDANDHSGVPVG

SEQ ID NO: 63 - protein, 345 aa, Ricinus communis
  misc_feature (1)..(345): Public GI ID no. 255549086
  misc_feature (201)..(299): Pfam Name: 2OG-FeII_Oxy Pfam Description: 2OG-Fe(II) oxygenase superfamily
  misc_feature (1)..(345): Bit score of 440.9 for HMM based on sequences of Figure 4
  misc_feature (1)..(345): Functional Homolog Of SEQ ID NO. 1
MATLAEACKDYSLHLHQIIPLDFDSIRTLPESHVWPESGEFEFNDGQLSIPTIDLNDPDAGNLIGHACETWGVFQVIHHNIPLNLLHEVESETRRLFSLPARQKLKALRSAGGAVGYGRARISHFFNKHMWHEGFTIMGSPVDHARQLWPHDYQRFCDVMEGYEKKMKELATTLMRVIFKYLGISEEQTKWVGSPGCSSAALQLNSYPYCPDPNRAMGLAPHTDTSFLTILHQSSTKGLQIFKEGVGWVLVYPTSGALVVNVGDFLHILSNARFPNVLHRVIMKECKQQRFSVAFFHCPSTDFSLFPLGLSSSCGEFPLYRSVSAAEYIGIKAKNIDNPLALIRI

SEQ ID NO: 64 - protein, 341 aa, Populus trichocarpa
  misc_feature (1)..(341): Public GI ID no. 224141841
  misc_feature (1)..(341): Ceres Annot ID no. 1477579
  misc_feature (200)..(297): Pfam Name: 2OG-FeII_Oxy Pfam Description: 2OG-Fe(II) oxygenase superfamily
  misc_feature (1)..(341): Bit score of 451.7 for HMM based on sequences of Figure 4
  misc_feature (1)..(341): Functional Homolog Of SEQ ID NO. 1
MSALSEAYRDHPLHLHHIIPLDFDSVRTVPDSHVWPTSHAFESDDQLSIPTVDLMDPDAVKLVGHACETWGVFQVINHGIPLDIIDEVESEARRLFSLPTGHKLKALRSPGGATGYGLARISPFFSKKMWHEGFTVMGSPVDHARELWPNDYQRFCDVMEDYQKKMKELAITLMHLILKSLDLSEEEISKVVSPGGASTALQLNSYPFCPDPSRVMGLAPHTDTSLLTILYQSTINGLEIFKDGVGWVLVSPTNGSLVVNVGDLLHILSNAQFPSVLHRVVLKEKQQRLSLAYFYSPPTDFDVSPLALNPAQIPLYRSVSVREYIHIKAKNVEKALSLIRI

SEQ ID NO: 65 - protein, 358 aa, Chrysanthemum x morifolium
  misc_feature (1)..(358): Public GI ID no. 194459446
  misc_feature (196)..(292): Pfam Name: 2OG-FeII_Oxy Pfam Description: 2OG-Fe(II) oxygenase superfamily
  misc_feature (1)..(358): Bit score of 566.3 for HMM based on sequences of Figure 4
  misc_feature (1)..(358): Functional Homolog Of SEQ ID NO. 1
MSLKPLKAENHKDLSSMKELPDSYAWSSVDDDCLLSCSSEPVPVINLEDPNVMKHVGHACKTWGVFHVTNHGIPMAVLDDMEASVRKLFYLPIQQKLKAARAPDGVSGYGAVRISSFFHKHMWSEGFTIIGSPYEHAKKLWPQDYKNFCVVVDEYNKEMKKLTNRLMWLVLGSLGITEGDVKWARQTRDTKEACPALQLNSYPACPDPDRAMGLAAHTDSSLLTILHQNNTSGLQVQREGMGWVTVPPIKGALVVHVGDLLHILSNGLYSSVLHRAIVNRAQHRLSIAYIYGPPSNVRISPLSKLTSIVRPPLYQPVTWSEYLAIKAKYFNKTLSIVRLSAPVNGFVDLKDHKSVIVG

SEQ ID NO: 66 - protein, 358 aa, Arabidopsis thaliana
  misc_feature (1)..(358): Ceres Annot ID no. 832701
  misc_feature (211)..(305): Pfam Name: 2OG-FeII_Oxy Pfam Description: 2OG-Fe(II) oxygenase superfamily
  misc_feature (1)..(358): Bit score of 505.9 for HMM based on sequences of Figure 4
  misc_feature (1)..(358): Functional Homolog Of SEQ ID NO. 1
MPAMLTDVFRGHPIHLPHSHIPDFTSLRELPDSYKWTPKDDLLFSAAPSPPATGENIPLIDLDHPDATNQIGHACRTWGAFQISNHGVPLGLLQDIEFLTGSLFGLPVQRKLKSARSETGVSGYGVARIASFFNKQMWSEGFTITGSPLNDFRKLWPQHHLNYCDIVEEYEEHMKKLASKLMWLALNSLGVSEEDIEWASLSSDLNWAQAALQLNHYPVCPEPDRAMGLAAHTDSTLLTILYQNNTAGLQVFRDDLGWVTVPPFPGSLVVNVGDLFHILSNGLFKSVLHRARVNQTRARLSVAFLWGPQSDIKISPVPKLVSPVESPLYQSVTWKEYLRTKATHFNKALSMIRNHREE

SEQ ID NO: 67 - protein, 370 aa, Triticum aestivum
  misc_feature (1)..(370): Public GI ID no. 85540946
  misc_feature (209)..(306): Pfam Name: 2OG-FeII_Oxy Pfam Description: 2OG-Fe(II) oxygenase superfamily
  misc_feature (1)..(370): Bit score of 596.8 for HMM based on sequences of Figure 4
  misc_feature (1)..(370): Functional Homolog Of SEQ ID NO. 1
MPTPSHLSKDPRYFDFRAARRVPETHAWPGLHDHPVVDGSGAGGGPDAVPVVDMRDPCAAEAVALAAQDWGAFLLEGHGVPLELLAGVEAAIGGMFALPASEKMRAVRRPGDSCGYGSPPISSFFSKCMWSEGYTFSPANLRSDLRKLWPKAGHDYRHFCAVMEEFHREMRALADKLLELFLVALGLTGEQVAAVESEHKIAETMTATMHLNWYPKCPDPKRALGLIAHTDSGFFTFVLQSLVPGLQLFRHGPDRWVTVPAVPGAMVVNVGDLFQILTNGRFHSVYHRAVVNRDSDRISLGYFLGPPAHVKVAPLREALAGTPAAYRAVTWPEYMGVRKKAFTTGASALKMVAISTDNDAANDTDDLISS

SEQ ID NO: 68 - DNA, 1358 bp, Zea mays
  misc_feature (1)..(1358): Ceres Clone ID no. 442759
  misc_feature (1)..(1358): Encodes the peptide sequence at SEQ ID NO. 69
gattatctctatcctgtacgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcctgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcatc

SEQ ID NO: 69 - protein, 371 aa, Zea mays
  misc_feature (1)..(371): Ceres Clone ID no. 442759
  misc_feature (223)..(308): Pfam Name: 2OG-FeII_Oxy Pfam Description: 2OG-Fe(II) oxygenase superfamily
  misc_feature (1)..(371): Bit score of 479.6 for HMM based on sequences of Figure 4
  misc_feature (1)..(371): Functional Homolog Of SEQ ID NO. 1
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKACAGRRPGEPTATGYGRPPLALRFSKLMWSEGYTFRAATVREEFRRVWPDGGDDYLRFCDVMEEYDREMRALGGRLLDLFFMALGLTDVQFATGETERRIRETWTATMHPILCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 70 - protein, 384 aa, Oryza sativa
  misc_feature (1)..(384): Public GI ID no. 115462397
  misc_feature (1)..(384): Oryza sativa Japonica Group
  misc_feature (232)..(327): Pfam Name: 2OG-FeII_Oxy Pfam Description: 2OG-Fe(II) oxygenase superfamily
  misc_feature (1)..(384): Bit score of 457.0 for HMM based on sequences of Figure 4
  misc_feature (1)..(384): Functional Homolog Of SEQ ID NO. 1
MQIMTSSSTSPTSPTSPLAAAADNGVAAAYFNFRGAERVPESHVWKGMHEKDTAPVAAADADGGDAVPVVDMSGGDDAAVAAVARAAEEWGGFLLVGHGVTAEALARVEAQAARLFALPADDKARGARRPGGGNTGYGVPPYLLRYPKQMWAEGYTFPPPAIRDEFRRVWPDAGDDYHRFCSAMEEYDSSMRALGERLLAMFFKALGLAGNDAPGGETERKIRETLTSTIHLNMFPRCPDPDRVVGLAAHTDSGFFTFILQSPVPGLQLLRHRPDRWVTVPGTPGALIVVVGDLFHVLTNGRFHSVFHRAVVNRERDRISMPYFLGPPADMKVTPLVAAGSPESKAVYQAVTWPEYMAVRDKLFGTNISALSMIRVAKEEDKES

SEQ ID NO: 71 - protein, 358 aa, Chrysanthemum x morifolium
  misc_feature (1)..(358): Public GI ID no. 190192214
  misc_feature (196)..(292): Pfam Name: 2OG-FeII_Oxy Pfam Description: 2OG-Fe(II) oxygenase superfamily
  misc_feature (1)..(358): Bit score of 566.7 for HMM based on sequences of Figure 4
  misc_feature (1)..(358): Functional Homolog Of SEQ ID NO. 1
MSLKLLKAENHMDLSSMKELPDSYAWASVDDGCLLSCSSEPVPVINLDDPNVMKHVGHACKTWGVFYVTNHGIPMAVVDDMEASVRKLFYLPIQQKLKAARAPDGVSGYGAVRISSFFHKHMWSEGFTIIGSPYEHAKKLWPHDYKNFCEVVDEYNKEMKKLTNRLMWLVLGSLGITEGDVKWAGPAGDLKEACPALQLNSYPACPDPDRAMGLAAHTDSSLLTILHQNNTSGLQVQREGMGWVTVPPIKGALVVHVGDLLHILSNGLYSSVLHRAIVNRTQHRFSIAYLYGPPSNVRISPLSKLTSIVRPPLYQPVTWSEYLAIKAKYFNKTLSVVRLSAPVDGFVDLKDHKSVIVG

SEQ ID NO: 72 - protein, 370 aa, Marah macrocarpus
  misc_feature (1)..(370): Public GI ID no. 304636273
  misc_feature (207)..(302): Pfam Name: 2OG-FeII_Oxy Pfam Description: 2OG-Fe(II) oxygenase superfamily
  misc_feature (1)..(370): Bit score of 493.3 for HMM based on sequences of Figure 4
  misc_feature (1)..(370): Functional Homolog Of SEQ ID NO. 1
MATKITDAFKSHPVHVPAHKNLDFDSFNELPDTYEWVQPDSIPSPNDQSQEHLPLIDLSLPNAAALVGDAFRSWGAFQAINHGVPISLLHSFESTVDTLFSLPPSDKHKAARTPDGVDGYGLVRISSFFPKRMWSEGFTILNSPLHHFQKLWPDDYAKHCEIYEEYDREMRSLCARLIWLGLGELGITQDDVELAGPDRDFKTNPAATQLNSYPICPDPERAMGLGAHTDTSLLTIVYQNNTSGLQFLREGNRWVTVEPVDGALVVQVGDLLQIMTNGLYKSPLHQAFVNRTRKRLSMAYIFGTPETAEISPLKKLLGPTQPPIYRTVTWTEYLGKKAEHFNNALKSVRICAPSANGLLDVNDQSQVKVG

SEQ ID NO: 73 - DNA, 1405 bp, Glycine max
  misc_feature (1)..(1405): Ceres Clone ID no. 476411
  misc_feature (1)..(1405): Encodes the peptide sequence at SEQ ID NO. 74
aatctcaactcatctttcagtaacatattccgtagcatctacccagtcagtactcaccaatggcaataggccaatagctataattgcccaaacccaactcataatttcaaattttgctcaatactttatctacaggtgtaacattgattaaacacaaacacaaatcacctcttgttggttcttaatttctttcttccactatgccttctctctcggaagcctttagaggtcaccccgtgtaccttcatcagaaacaccacgacttcaactcacttcaagaactccctgactcttacgcttggacacaacctgatgatgatgatcaccgtctcacaaattacccttccaacaataagactaagaccgttgtccccatcatcgatttgaacgacccaaatgctccaaacctcataggccatgcatgcaaaacatggggtgtgttccaagtggtgaaccatggcatccccacgagcctcttcagtgacattcagagggctagtcttgctctattctcccttcctcttcaccagaagctcaaagcagctcgctcccccgacggcgtctccggctacggccgcgctcgcatttcctccttcttccccaagctcatgtggtctgagtgcttcacaattctcgattcccctcttgatcttttcctcaaactctggccacaagactatgctaaatactgtgatattgtcgtggaatatgaagcagccatgaaaaagctagcagcgaagttaatgtgccttatgttggcttcccttggtattcccaaggaagacattaaatgggctgggccgaaaggagaattcaacggggcttgtgcggctttgcattggaattcttacccgagttgcccggatccggatcgggccatgggtctggccgcgcacacggactccactctcctcacaatcctgcaccaaaacaatgtcaatgggcttcaggttctcaaggaaggggaagggtgggtggcggtgcctccgcttcccggagggctcgtgatcaacgtcggcgatctgctccacattttgtcaaacgggttgtacccgagtgtgctgcatcgagttcgggtgaaccgaacccggcagaggttctcggttgcttatctatatgggcccccaacaaacgtccaaatcagtccacaagtaaaattggtaggcccaacaaggcccgttctttatcgatcagtgacttggaacgagtaccttggcaccaaagcaaagctttttaataaggctctttcagctgttaggctttcttcatctattaacggtttgtttgatgtaaacgaggataagagtaacgactttcaagtgggctagaatctagatagccataggcttgaactttttttacccttctcggtcaaatcttgtaccagccataaaaggcaaaaatg

SEQ ID NO: 74 - protein, 375 aa, Glycine max
  misc_feature (1)..(375): Ceres Clone ID no. 476411
  misc_feature (214)..(307): Pfam Name: 2OG-FeII_Oxy Pfam Description: 2OG-Fe(II) oxygenase superfamily
  misc_feature (1)..(375): Bit score of 558.4 for HMM based on sequences of Figure 4
  misc_feature (1)..(375): Functional Homolog Of SEQ ID NO. 1
MPSLSEAFRGHPVYLHQKHHDFNSLQELPDSYAWTQPDDDDHRLTNYPSNNKTKTVVPIIDLNDPNAPNLIGHACKTWGVFQVVNHGIPTSLFSDIQRASLALFSLPLHQKLKAARSPDGVSGYGRARISSFFPKLMWSECFTILDSPLDLFLKLWPQDYAKYCDIVVEYEAAMKKLAAKLMCLMLASLGIPKEDIKWAGPKGEFNGACAALHWNSYPSCPDPDRAMGLAAHTDSTLLTILHQNNVNGLQVLKEGEGWVAVPPLPGGLVINVGDLLHILSNGLYPSVLHRVRVNRTRQRFSVAYLYGPPTNVQISPQVKLVGPTRPVLYRSVTWNEYLGTKAKLFNKALSAVRLSSSINGLFDVNEDKSNDFQVG

SEQ ID NO: 75 - protein, 374 aa, Pisum sativum
  misc_feature (1)..(374): Public GI ID no. 2291080
  misc_feature (210)..(306): Pfam Name: 2OG-FeII_Oxy Pfam Description: 2OG-Fe(II) oxygenase superfamily
  misc_feature (1)..(374): Bit score of 603.4 for HMM based on sequences of Figure 4
  misc_feature (1)..(374): Functional Homolog Of SEQ ID NO. 1
MPSLSEAYRAHPVHVNHKHPDFNSLQELPESYNWTHLDDHTLIDSNNIMKESTTTVPVIDLNDPNASKLIGLACKTWGVYQVMNHGIPLSLLEDIQWLGQTLFSLPSHQKHKATRSPDGVSGYGIARISSFFPKLMWYEGFTIVGSPLDHFRELWPQDYTRFCDIVVQYDETMKKLAGTLMCLMLDSLGITKEDIKWAGSKAQFEKACAALQLNSYPSCPDPDHAMGLAPHTDSTFLTILSQNDISGLQVNREGSGWITVPPLQGGLVVNVGDLFYILSNGLYPSVLHRVLVNRTRQRFSVAYLYGPPSNVEICPHAKLIGPTKPPLYRSVTWNEYLGTKAKHFNKALSSVRLCTPINGLFDVNDSNKNSVQVG

SEQ ID NO: 76 - protein, 355 aa, Marah macrocarpus
  misc_feature (1)..(355): Public GI ID no. 304636275
  misc_feature (214)..(312): Pfam Name: 2OG-FeII_Oxy Pfam Description: 2OG-Fe(II) oxygenase superfamily
  misc_feature (1)..(355): Bit score of 415.3 for HMM based on sequences of Figure 4
  misc_feature (1)..(355): Functional Homolog Of SEQ ID NO. 1
MTTLSETYRDHPLHLQHIVPLDFTSLRTVPDSHDWPQSASHDIATSSSHELHTNGDVSIPLIDLTDPDAAMLISNACKTWGVFQLTNHVVPMSLIERVEGVSGRLFDLPMTRKLKALRASGGATGYGLPRITPFFSKYMWHEGFTIIGSPTDHASQLWPSNYQPFCDAMEEYQRKMKSLAEQITHLILSSLNNNPDDAGIKNWLDSAGAAACSTALQLNCYPPCPDPTRVMGLAPHTDTFLLTILHQSRTCGLQIFRDGAGWVPVPLVAGALIVNVGDLFHIMSNGRFPNVLHRVVVDPTRRRLSMAYFYGPPPDFCVSPLNKPPESLRYQSVVVKDYVRLKAKNLENALSMIKI

SEQ ID NO: 77 - protein, 354 aa, Ricinus communis
  misc_feature (1)..(354): Public GI ID no. 255549006
  misc_feature (205)..(302): Pfam Name: 2OG-FeII_Oxy Pfam Description: 2OG-Fe(II) oxygenase superfamily
  misc_feature (1)..(354): Bit score of 448.4 for HMM based on sequences of Figure 4
  misc_feature (1)..(354): Functional Homolog Of SEQ ID NO. 1
MNSIKESNPTLLLPNNIFPLDFTSILTLPDSHAWTTPPSLDPLTSQDDSIIPVIDLNSPNALILIKEASENWGMFQVTNHDIPIHLFHHIEGQTRCLFGLPSSQKLLAARSPGGLTGYGRARISDFFKREMWYEGFTIMGSPAEHASQLWPNQDTSFCDAVKAYQKEMKGLSERIIGLMFKSLGLIEEDVKFLGLKDESQYPQGALQLNSYPKCPDPDRAMGLAPHTDSSLITVLHQDGVSGLQVFKDGIGWMPVCPVDGALVVNIGDLMHIISNGRFKCAQHQAVVNKTHHRISVAYFYGPPGDVKISPLMQLVDFDHPVLYRPVTWKEYLDAKTIYFDKALDFIKSDESMCQ

SEQ ID NO: 78 - DNA, 1335 bp, Glycine max
  misc_feature (1)..(1335): Ceres Clone ID no. 1653303
  misc_feature (1)..(1335): Encodes the peptide sequence at SEQ ID NO. 79
acctcatcatctctatctttccatgcggtaccgtgttttctttgcatcaacggctactatttttgaacttgtcataattagtctctatttctaattagtatcgaatacacacacacaccttaaacgtaagtggtcactatttgttccacactattatgccttcactctcagaagcctaccgatcccaccccgtgcacgttcaacacaagcaccctgacttaaactccctacaagaactccccgagtcttacacttggacacaccatggccatgatgatcacactaattcccctgcttccaacgagagtgtccccgttattgatctcaatgacccaaatgcttcaaagttgatacaccatgcatgcacaacttggggagcgtaccaagtgctgaaccatggcatacccatgagcctcctccaagacattcaatgggttggggagaccctattctctctcccttctcaccaaaaacacaaagcagctcgttcccctgacggtgttgatggctatggcctcgctcgcatctcttccttcttccccaaactcatgtggtctgaaggcttcacaattgttggatcccctcttgagcattttcgccaactctggccccaagattacgacaaatactgtgatttcgtcatgcaatatgacgaagccatgaaaaagctagtgggaaagctgatgttgctcatgttggattctctgggtattacaaaggaataccttaaatgggctggctcaaaaggccaattcgaaaagacttgtgctgccttgcaattgaattcatacccgacttgtccggatccggatcgggccatgggtctagccgcccacaccgactccacccttctcacaatcctttaccaaaacaacataagcgggttgcaggttcaccgaaaaggcgtcgggtgggtgacggtgccaccactctccggcggacttgtgatcaatgtaggcgacctcctccacatattgtcgaacgggttgtacccgagtgtgctccaccgggtcttagtgaaccggatccagcgaaggctttcagttgcgtatttatgtgggccccctccaaatgtggagatatgtccacatgcgaagttagtgggcccaaataagcctcccctttataaggcagtgacttggaatgagtaccttgggaccaaagcaaagcattttaacaaggcactctcaactgttcggctttgtgcacctagctagatgtaaaacagcctcacaccaatagtgagcagcaagtgggctatagattgctttgaaccttttgcatgctctattttgtaccaaacatgaatgaaataccttcttcttcttttttgct

SEQ ID NO: 79 - protein, 353 aa, Glycine max
  misc_feature (1)..(353): Ceres Clone ID no. 1653303
  misc_feature (206)..(302): Pfam Name: 2OG-FeII_Oxy Pfam Description: 2OG-Fe(II) oxygenase superfamily
  misc_feature (1)..(353): Bit score of 569.2 for HMM based on sequences of Figure 4
  misc_feature (1)..(353): Functional Homolog Of SEQ ID NO. 1
MPSLSEAYRSHPVHVQHKHPDLNSLQELPESYTWTHHGHDDHTNSPASNESVPVIDLNDPNASKLIHHACTTWGAYQVLNHGIPMSLLQDIQWVGETLFSLPSHQKHKAARSPDGVDGYGLARISSFFPKLMWSEGFTIVGSPLEHFRQLWPQDYDKYCDFVMQYDEAMKKLVGKLMLLMLDSLGITKEYLKWAGSKGQFEKTCAALQLNSYPTCPDPDRAMGLAAHTDSTLLTILYQNNISGLQVHRKGVGWVTVPPLSGGLVINVGDLLHILSNGLYPSVLHRVLVNRIQRRLSVAYLCGPPPNVEICPHAKLVGPNKPPLYKAVTWNEYLGTKAKHFNKALSTVRLCAPS

SEQ ID NO: 80 - DNA, 1029 bp, Populus trichocarpa
  misc_feature (1)..(1029): Ceres Annot ID no. 1508682
  misc_feature (1)..(1029): Encodes the peptide sequence at SEQ ID NO. 81
atgagcactctttctgaagcctatcgagaccttcctcaccatccccaccatattatcccactagactttgattcggtccgaaccttgcccgactcacatgtatggcagcctacttcccatgcctctgagtccgaagaccgattatcgattcccactgtcgacctcaaggatcctgatgcagggaaactgatagggcatgcttgtgaggcatggggcgcgttccaagtcacaaaccatgacattccattggacctattccatgaagttgagtccgaggctagaagactcttctctctcccgacaggacagaaattgaaggccttaaggtctcctggtggagccaccggctatggcttagctcggatttcgccattcttcaacaagtatatgtggcatgaagggtttacaatcatgggttcttctattgatcacgctagggatctctggcccaatgactaccaaaggttttgcgatgtaatggaagattatcagaagaaaatgaaggagctagccgtaaccctaatgcatctagttctcaagtccttggacatatctgaagaagaaataagtagagtcgtttcagctggaggtgacagcactgctttacagctgaactcttatccattatgtcctgacccaaatcgagccatgggtctagctccccacacagacacttccctcttgacaatactacaccaaagtacagtaaatggcttgcaaatcttcaaagaaggagttggttgggttctagtatctcccacaaacggatctcttgtagtaaatgtgggtgatctcctgcatattctctcaaatgctcagtttcgtagtgttcttcatcgtgtggttatgaaagagaaccaacaaaggctgtccttggcttatttttactgccttccttctgatttccatatctctcctctggctttgaattctacccaaatgcctctatatcgttctgtatcggtcagagattatattggcatcaaggctaagaatcttgagaaagcactatctttgatcagaatttag

SEQ ID NO: 81 - protein, 342 aa, Populus trichocarpa
  misc_feature (1)..(342): Ceres Annot ID no. 1508682
  misc_feature (201)..(297): Pfam Name: 2OG-FeII_Oxy Pfam Description: 2OG-Fe(II) oxygenase superfamily
  misc_feature (1)..(342): Bit score of 454.2 for HMM based on sequences of Figure 4
  misc_feature (1)..(342): Functional Homolog Of SEQ ID NO. 1
MSTLSEAYRDLPHHPHHIIPLDFDSVRTLPDSHVWQPTSHASESEDRLSIPTVDLKDPDAGKLIGHACEAWGAFQVTNHDIPLDLFHEVESEARRLFSLPTGQKLKALRSPGGATGYGLARISPFFNKYMWHEGFTIMGSSIDHARDLWPNDYQRFCDVMEDYQKKMKELAVTLMHLVLKSLDISEEEISRVVSAGGDSTALQLNSYPLCPDPNRAMGLAPHTDTSLLTILHQSTVNGLQIFKEGVGWVLVSPTNGSLVVNVGDLLHILSNAQFRSVLHRVVMKENQQRLSLAYFYCLPSDFHISPLALNSTQMPLYRSVSVRDYIGIKAKNLEKALSLIRI

SEQ ID NO: 82 - protein, 358 aa, Camelina sativa
  misc_feature (1)..(358): Public GI ID no. 294471308
  misc_feature (211)..(305): Pfam Name: 2OG-FeII_Oxy Pfam Description: 2OG-Fe(II) oxygenase superfamily
  misc_feature (1)..(358): Bit score of 517.0 for HMM based on sequences of Figure 4
  misc_feature (1)..(358): Functional Homolog Of SEQ ID NO. 1
MPAMLTDVFRGHPIHLPHSHQPDFTSLRELPDSYSWTPKDDILFAAAPSPPTAVETIPLIDLDHPDAANQIGHACRTWGAFQIANHGVPLSLLQDVEFLTESLFGLPVKRKLKAARSETGVSGYGVARIASFFNKQMWSEGFTITGSPLNDFRKLWPQDHLNYCDIVEEYEERMKKLASKLMWLALNSLGVTEEDVEWARLTSDLSWAQAALQLNHYPVCPEPDRAMGLAAHTDSTLLTILYQNNTAGLQVFRDDLGWITVPPVPGSLVVNVGDLFHILSNGLFKSVLHRARVNQTRARLSVAFLWGPQSDIKISPVPKLVSPLESPLYRSVTWREYLQTKATHFNKALSMIRNHREE

SEQ ID NO: 83 - protein, 373 aa, Solanum lycopersicum
  misc_feature (1)..(373): Public GI ID no. 3834350
  misc_feature (211)..(307): Pfam Name: 2OG-FeII_Oxy Pfam Description: 2OG-Fe(II) oxygenase superfamily
  misc_feature (1)..(373): Bit score of 616.4 for HMM based on sequences of Figure 4
  misc_feature (1)..(373): Functional Homolog Of SEQ ID NO. 1
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWSEGFTIVGSPIEHARQLWPKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 84 - protein, 374 aa, Pisum sativum
  misc_feature (1)..(374): Public GI ID no. 2316102
  misc_feature (210)..(306): Pfam Name: 2OG-FeII_Oxy Pfam Description: 2OG-Fe(II) oxygenase superfamily
  misc_feature (1)..(374): Bit score of 602.7 for HMM based on sequences of Figure 4
  misc_feature (1)..(374): Functional Homolog Of SEQ ID NO. 1
MPSLSEAYRAHPVHVNHKHPDFNSLQELPESYNWTHLDDHTLIDSNNIMKESTTTVPVIDLNDPNASKLIGLACKTWGVYQVMNHGIPFSLLEDIQWLGQTLFSLPSHQKHKATRSPDGVSGYGIARISSFFPKLMWYEGFTIVGSPLDHFRELWPQDYTRFCDIVVQYDETMKKLAGTLMCLMLDSLGITKEDIKWAGSKAQFEKACAALQLNSYPSCPDPDHAMGLAPHTDSTFLTILSQNDISGLQVNREGSGWITVPPLQGGLVVNVGDLFYILSNGLYPSVLHRVLVNRTRQRFSVAYLYGPPSNVEICPHAKLIGPTKPPLYRSVTWNEYLGTKAKHFNKALSSVRLCTPINGLFDVNDSNKNSVQVG

SEQ ID NO: 85 - protein, 373 aa, Oryza sativa
  misc_feature (1)..(373): Public GI ID no. 11034551
  misc_feature (1)..(373): Oryza sativa Japonica Group
  misc_feature (209)..(304): Pfam Name: 2OG-FeII_Oxy Pfam Description: 2OG-Fe(II) oxygenase superfamily
  misc_feature (1)..(373): Bit score of 575.9 for HMM based on sequences of Figure 4
  misc_feature (1)..(373): Functional Homolog Of SEQ ID NO. 1
MPTPSHLKNPLCFDFRAARRVPETHAWPGLDDHPVVDGGGGGGEDAVPVVDVGAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 86 - protein, 373 aa, Solanum tuberosum
  misc_feature (1)..(373): Public GI ID no. 15418964
  misc_feature (211)..(307): Pfam Name: 2OG-FeII_Oxy Pfam Description: 2OG-Fe(II) oxygenase superfamily
  misc_feature (1)..(373): Bit score of 608.4 for HMM based on sequences of Figure 4
  misc_feature (1)..(373): Functional Homolog Of SEQ ID NO. 1
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWFEGFTIVGSPIEHARQLWLKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 87 - protein, 340 aa, Phaseolus coccineus
  misc_feature (1)..(340): Public GI ID no. 71532877
  misc_feature (199)..(295): Pfam Name: 2OG-FeII_Oxy Pfam Description: 2OG-Fe(II) oxygenase superfamily
  misc_feature (1)..(340): Bit score of 371.0 for HMM based on sequences of Figure 4
  misc_feature (1)..(340): Functional Homolog Of SEQ ID NO. 1
METLNDAYKAHPLDLGDIIPIDFSSSPAIPDSHSWSEPNDNRISSDDPPPVIDLLDPKAKDLISLACQNSGAFQLTNHGIPLGVIQAAEEEVEHLFSLPTEQKMKALRTPDGATGYGRARISPFFPKGMWHEGFTIIGSISQDVKKIWPDDHARFCDRMEDYEKKMKILAERVTEILFDLLNVSEEKRKWVDAEDKGTAIQLNFYPSCPEPNRTMGLAPHTDTSIITIVQSPSTGLQLYKEEKGWISVQPHPEALIVHLGDLAHIISNGRFCSPLHRVTLSETCKRYSIAYFYSPPIDHVLSPFVTEDDKSAAQFRPVTVKEYIAIKAQHFGNSISFVKI

SEQ ID NO: 88 - protein, 367 aa, Ipomoea nil
  misc_feature (1)..(367): Public GI ID no. 40714039
  misc_feature (196)..(292): Pfam Name: 2OG-FeII_Oxy Pfam Description: 2OG-Fe(II) oxygenase superfamily
  misc_feature (1)..(367): Bit score of 440.1 for HMM based on sequences of Figure 4
  misc_feature (1)..(367): Functional Homolog Of SEQ ID NO. 1
MNQEIDNIIPMDFNKADQLPDSHTWLDDHSPVNSSSTHESVPLIDLYDPQAVDKIKMACETWGIFQVTNHGVPWSLLAQIEHQARRFFELAPEQKLRAVRSPGSLAGYGTVRISKFFDSQMWSEGFTVAGSPLEHARQVWPQDYSDFCSVIDDYQEKMRGLAEKIAALMFKSLGLSPGEDVEWFEPNGLSNSTQAYLQMNWYPKCPDPTRAMGLAQHTDTSLVTLLYQTSNIRGLQVYGPNLNWVDVKPISDAIVVNLGDLMQIISNGRFKSVLHRAIVSEAHNRISVGYFFGSSKNVEISPSLKLIKGSEFPMYKPISWNEYLDIKNKYFNKSLEMIGFNSDVEKSNALASGDEAPLGSEVEAIKV

SEQ ID NO: 89 - protein, 355 aa, Solanum lycopersicum
  misc_feature (1)..(355): Public GI ID no. 3834352
  misc_feature (192)..(289): Pfam Name: 2OG-FeII_Oxy Pfam Description: 2OG-Fe(II) oxygenase superfamily
  misc_feature (1)..(355): Bit score of 563.6 for HMM based on sequences of Figure 4
  misc_feature (1)..(355): Functional Homolog Of SEQ ID NO. 1
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVPLLRGALVINVGDLLHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 90 - protein, 356 aa, Ricinus communis
  misc_feature (1)..(356): Public GI ID no. 255546615
  misc_feature (205)..(302): Pfam Name: 2OG-FeII_Oxy Pfam Description: 2OG-Fe(II) oxygenase superfamily
  misc_feature (1)..(356): Bit score of 441.4 for HMM based on sequences of Figure 4
  misc_feature (1)..(356): Functional Homolog Of SEQ ID NO. 1
MNSIKESNPTQLLPNNIVPLDFTSILTLPDSHAWTTPPSLDPLTSQDDSIIPVIDLNGPNVLILIKEASENWGMFQVTNHDIPIHLFHHIEGQTRCLFGLPSTQKLLAARSPGGLTGYGRARISDFFTREMWYEGFTIMGSPAEHASQLWPNQDTSFCNVMEACQKEMKGLSERIIGIMFKSLGLNEEDVKFLGLKDGSQYPQGALQLNSYPKCPDPDRAMGLAPHTDSSLITVLHQGGVSGLQVFKEGIGWVPVSPVDDALVVNIGDLMHIISNGRFKCAQHQAVVNKTRHRISVAYFYGPPGDVKISPLMQLVDFDHPVLYCPVTWKEYLDAKAIYFDKALDFIKNDKSICQQQ

SEQ ID NO: 91 - protein, 373 aa, Populus tremula
  misc_feature (1)..(373): Public GI ID no. 38154346
  misc_feature (1)..(373): Populus tremula x Populus tremuloides
  misc_feature (211)..(307): Pfam Name: 2OG-FeII_Oxy Pfam Description: 2OG-Fe(II) oxygenase superfamily
  misc_feature (1)..(373): Bit score of 595.2 for HMM based on sequences of Figure 4
  misc_feature (1)..(373): Functional Homolog Of SEQ ID NO. 1
MPSRSLADAFRSHPVHLHQKHLDFSSLQEIPDSHKWTQLDDIEQQHPSVESFITESVPVIDLLDPNVLQNIGNACKTWGVLQVTNHGIPISLLESVEGVSRSLFSLPVQQKLKAARSPDGVSGYGVARISSFFSKLMWSEGFTIVGSPLEHFRQLWPQDYTKFCDVIEEHEKEMQKLARRLTWLMLGSLGITKKDLNWAGPKGESKEGGAALQLNSYPACPDPDLAMGLAAHTDSTLLTILYQNNTSGLQVLKEGIGWVTVPPIPGGLVVNVGDLLHILSNGLYPSVLHRAVVNRTKHRLSIAYLYGPPSSVQISPIQKLVGPNHPPLYRPITWNEYLVAKAKHFNKALSSVRICAPLNGLVDVNDHNSVKVG

SEQ ID NO: 92 - protein, 377 aa, Medicago sativa
  misc_feature (1)..(377): Public GI ID no. 145206859
  misc_feature (1)..(377): Medicago sativa subsp. caerulea
  misc_feature (213)..(309): Pfam Name: 2OG-FeII_Oxy Pfam Description: 2OG-Fe(II) oxygenase superfamily
  misc_feature (1)..(377): Bit score of 602.4 for HMM based on sequences of Figure 4
  misc_feature (1)..(377): Functional Homolog Of SEQ ID NO. 1
MPSLSEAYRAHPVHVNHKHPDFNSLQELPESYTWTHLDDHTLINSNNTMKESANSSSVPVIDLNDPNASKLIGHACKTWGVYQVVNHGIPISLLDEIQWLGQTLFTLPSHQKLKAIRSPDGVSGYDLARISSFFPKLMWSEGFTIVGSPLDHFRQLWPQDYAKHCDTVLQYDEAMKKLAGKLMWLMLDSLGITMEDIEWAGSKAQFDEKACAAMQLNSYPSCPDPDHAMGLAPHTDSTFLTILSQNDISGLQVQGEGSGWVTVPPLHGGLVVNVGDLFHILSNGLYTSVLHRVLVNRTRQRFSVAYLYGPPSNVEICPHEKLVGPTQPPLYRSVTWNEYLGTKAKHFNKALSSVSLCAPINGLFDVNDSNKSSVQVG

SEQ ID NO: 93 - DNA, 1119 bp, Populus trichocarpa
  misc_feature (1)..(1119): Ceres Annot ID no. 1438976
  misc_feature (1)..(1119): Encodes the peptide sequence at SEQ ID NO. 94
atgccttcaagatcgttattagcagacgcttttagagcccaccctgtccatgtacaccaaaagcacattgactttacctctcttcaagaaatacctgactcgcacaaatggactcagatcgatgatgaacagcatcctttagttgaccccttaaacactgaatccgtgcccgttatcgatctgtcagaccctaatgtccttcaaaatataggccatgcatgcaaaacttggggtgtgcttcaagtcacaaaccatggcatccctaccagccttcttgagaacattgagagtgctagtaggagccttttctctttacctatccaacaaaaactcaaagcagctagatcacccgatggggtttcaggctacggtgtcgctaggatttcttcatttttctccaagctcatgtggtcagagggattcaccatagttggctctcctcttgagcattttcgccaactttggtctcaagattacaccaaattctgtgatataattgaagaatataagaaagaaatgcaaaagctagcaaggaggttgacatggttaatgctgggctcattaggaatagcaaagaaagatctcaaatgggctggctcaacaggtgaatcaaaaaagggtagtgcagccctacaactgaattactacccggcttgcccggatccagatcaggcaatgggtcttgccgcccacacagactccaccctcctcaccattctttaccagagcaacaccagtggattgcaggtgctaaaagagggaattgggtggatcactgtcccaccaatccctggtgggcttgttgtgaatgtaggggacctactccacatcttatcaaacgggttgtacccgagtgtgctccaccgagcggtggttaaccggaccaagcatagattatccattgctttcctatatgggccaccatcaagtgttgagatttctcctttacaaaaacttgtaggtcctaatcatcctcccctctataggccagtcacttggaacgaataccttggcaccaaagctaagtatttcaacaaagcattatcatctgttaggatttgtgctcctctaaatggtctggctgatgtaaacgatcataatagggtaagagttggttag

SEQ ID NO: 94 - protein, 372 aa, Populus trichocarpa
  misc_feature (1)..(372): Ceres Annot ID no. 1438976
  misc_feature (210)..(306): Pfam Name: 2OG-FeII_Oxy Pfam Description: 2OG-Fe(II) oxygenase superfamily
  misc_feature (1)..(372): Bit score of 598.1 for HMM based on sequences of Figure 4
  misc_feature (1)..(372): Functional Homolog Of SEQ ID NO. 1
MPSRSLLADAFRAHPVHVHQKHIDFTSLQEIPDSHKWTQIDDEQHPLVDPLNTESVPVIDLSDPNVLQNIGHACKTWGVLQVTNHGIPTSLLENIESASRSLFSLPIQQKLKAARSPDGVSGYGVARISSFFSKLMWSEGFTIVGSPLEHFRQLWSQDYTKFCDIIEEYKKEMQKLARRLTWLMLGSLGIAKKDLKWAGSTGESKKGSAALQLNYYPACPDPDQAMGLAAHTDSTLLTILYQSNTSGLQVLKEGIGWITVPPIPGGLVVNVGDLLHILSNGLYPSVLHRAVVNRTKHRLSIAFLYGPPSSVEISPLQKLVGPNHPPLYRPVTWNEYLGTKAKYFNKALSSVRICAPLNGLADVNDHNRVRVG

SEQ ID NO: 95 - protein, 370 aa, Oryza sativa
  misc_feature (1)..(370): Public GI ID no. 115434856
  misc_feature (1)..(370): Oryza sativa Japonica Group
  misc_feature (206)..(301): Pfam Name: 2OG-FeII_Oxy Pfam Description: 2OG-Fe(II) oxygenase superfamily
  misc_feature (1)..(370): Bit score of 565.2 for HMM based on sequences of Figure 4
  misc_feature (1)..(370): Functional Homolog Of SEQ ID NO. 1
MPTPSHLKNPLCFDFRAARRVPETHAWPGLDDHPVVDGGGGGGEDAVPVVDVGAGDAAARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 96 - protein, 347 aa, Arabidopsis thaliana
  misc_feature (1)..(347): Public ID no. sp_Q9ZT84_G3OX2_ARATH
  misc_feature (204)..(298): Pfam Name: 2OG-FeII_Oxy Pfam Description: 2OG-Fe(II) oxygenase superfamily
  misc_feature (1)..(347): Bit score of 481.9 for HMM based on sequences of Figure 4
  misc_feature (1)..(347): Functional Homolog Of SEQ ID NO. 1
MSSTLSDVFRSHPIHIPLSNPPDFKSLPDSYTWTPKDDLLFSASASDETLPLIDLSDIHVATLVGHACTTWGAFQITNHGVPSRLLDDIEFLTGSLFRLPVQRKLKAARSENGVSGYGVARIASFFNKKMWSEGFTVIGSPLHDFRKLWPSHHLKYCEIIEEYEEHMQKLAAKLMWFALGSLGVEEKDIQWAGPNSDFQGTQAVIQLNHYPKCPEPDRAMGLAAHTDSTLMTILYQNNTAGLQVFRDDVGWVTAPPVPGSLVVNVGDLLHILTNGIFPSVLHRARVNHVRSRFSMAYLWGPPSDIMISPLPKLVDPLQSPLYPSLTWKQYLATKATHFNQSLSIIRN

SEQ ID NO: 97 - protein, 372 aa, Ipomoea nil
  misc_feature (1)..(372): Public GI ID no. 40714037
  misc_feature (206)..(305): Pfam Name: 2OG-FeII_Oxy Pfam Description: 2OG-Fe(II) oxygenase superfamily
  misc_feature (1)..(372): Bit score of 554.6 for HMM based on sequences of Figure 4
  misc_feature (1)..(372): Functional Homolog Of SEQ ID NO. 1
MPTKVSDTCRPHHPIVSQILDLYSIKELPESHAWSSDDHTGSNSINFESIPVIDLDNYNHDNNFNILDTIGHACKKWGAFQLINHNISEKLLEDIEIAGRRLFSLPMQQKLKAARSPDGVSGYGLARISSFFDKLMWSEGFTIVGSPLEHSRLLWPQDFNSFCEVVEEYEKEMKKLAGRMMKLILESLGVAEEDAKWGVESKGRCSALQLNSYPACPDPGRAMGLAEHTDSTVLTILHQNNTSGLQVFREGAAGGWVTVPPIPGALVINAGDLLHILSNGLYHSVLHRAVVNRSSHRLSVAYLYGPPPGIKISPLPKLVAEGQPPLFRAITWSEYLRTKAKHFDKALSSVRLICAPRNPFSDTNDHNRVRVG

SEQ ID NO: 98 - protein, 360 aa, Nicotiana sylvestris
  misc_feature (1)..(360): Public GI ID no. 20149243
  misc_feature (197)..(294): Pfam Name: 2OG-FeII_Oxy Pfam Description: 2OG-Fe(II) oxygenase superfamily
  misc_feature (1)..(360): Bit score of 583.2 for HMM based on sequences of Figure 4
  misc_feature (1)..(360): Functional Homolog Of SEQ ID NO. 1
  misc_feature (194)..(194): Xaa is any aa, unknown, or other
MPSRISDDVHQKQLDLYTIKELPESHAWRSSLDHDYQCNDSLESIPVIDLNDEKFAIENIGHACKTWGAFQIINHNISQRLLDNMEEAGKRLFSLPMQQKLKAARSADGIAGYGVARISSFFSKLMWSEGFTIVGSPFDHARQLWPHDYKKFCDVIEEYEKEMEKLAGRLMWLMLGSLGISKDDMKWACCGPRXECSALQLNSYPACPDPDRAMGLAAHTDSTILTILHQNNTSGLQVFKEGNGWVTVPPLSGALVINVGDLLHILSNGLYPSVLHRAVVNRTRHRLSVAYLYGPPSGVKISPLSKLVDQGHPPLYRSVTWSEYLGTKAKHFDKALSSFQLCAPRIGFANPKDRNSVQVG

SEQ ID NO: 99 - protein, 354 aa, Oryza sativa
  misc_feature (1)..(354): Public GI ID no. 75324272
  misc_feature (1)..(354): Oryza sativa Japonica Group
  misc_feature (116)..(329): Pfam Name: Abhydrolase_3 Pfam Description: alpha/beta hydrolase fold
  misc_feature (110)..(210): Pfam Name: COesterase Pfam Description: Carboxylesterase family
  misc_feature (1)..(354): Bit score of 687.8 for HMM based on sequences of Figure 2
  misc_feature (1)..(354): in Figure 2
MAGSDEVNRNECKTVVPLHTWVLISNFKLSYNILRRADGTFERDLGEYLDRRVPANARPLEGVSSFDHIIDQSVGLEVRIYRAAAEGDAEEGAAAVTRPILEFLTDAPAAEPFPVIIFFHGGSFVHSSASSTIYDSLCRRFVKLSKGVVVSVNYRRAPEHRYPCAYDDGWTALKWVMSQPFMRSGGDAQARVFLSGDSSGGNIAHHVAVRAADEGVKVCGNILLNAMFGGTERTESERRLDGKYFVTLQDRDWYWKAYLPEDADRDHPACNPFGPNGRRLGGLPFAKSLIIVSGLDLTCDRQLAYADALREDGHHVKVVQCENATVGFYLLPNTVHYHEVMEEISDFLNANLYY

SEQ ID NO: 100 - DNA, 1770 bp, Panicum virgatum
  misc_feature (1)..(1770): Ceres Clone ID no. 1857760
  misc_feature (1)..(1770): Encodes the peptide sequence at SEQ ID NO. 101
ctctcccatctccccgccccccgcctgcgtcggcctctcaagtctcgccgggctcgattccgcgggatggctccggcgcggcgcggcctccgcggcccatgccgtgagtgaaggcgctggctttgccgtccgggggagtgatcttgccgcagcagcagcagcagccggaggccggtgctccggtggccgaggcccagcggcgcccgctcaccgccatggctggcagcgacgaggtcaaccgcaacgagtgcaagacggcggtgccgatccacacatgggtgctcatctccaacttcaagctggcgtacaacatgctccggcgggcggacggcaccttcgaccgcgacctcgccgagtacctcgaccgccgggtgccgcccgacgcgcgggcccaggagggcgtctcgtccttcgaccacgtcatcgacccctccgtcggcctcgaggtccgcatctaccgcgccgccgccaacaacgccgcgggcgccggcgccggcgcggcagcggtcacgctgcccatcctcgacttcctcaccggcgcgccgtcgccggacccgttcccggtcatcctcttcttccacggcggcagcttcgcgcactcctcgtccagcacggccatctacgacaacctgtgccgtcggttcgtgaagctgagcaagggcgtggtgctgtccgtcaactaccggcgcgcccccgagcaccggtacccgtgcgcctacgacgacggctgggccgcgctcaagtgggccatgtcgcagccgttcctccgcagcggcgagggcgcccagccccgcgtgttcctctccggcgactcctccggcggcaacatcgcccaccacgtggccgtgcgggccgccgacgccgggatcaggatctgcggcaacatcctgctcaacgccatgttcggcggcaccgagcgcaccgactcggagcggcggctggacggcaagtacttcgtcacgctccaggacagggactggtactggaaggcgtacctgcccgaggacgccgaccgggaccacccggcgtgcaacccgttcgggccgaacgggcggcggctcaggggcctccccttcaccaagagcctcatcatcgtgtcgggcctggacctcacctgcgaccggcagctggcctacgccgagggcctccgggaggacggtcaccatgtcaagctcgtgtaccgcgagaaggccaccatcggcttctacctgctgcccaacacagaccactaccacgaggtcatggaggagatctccgacttcctcggggctaacctcctctagtacatacgtacaccacagctgctgatcctgatctgatcgtcgccttcgcacactccacttgttatagcaagatggtaagcttgacttatactagttctgtcgtctcgtctcgccgtatactgctgctgctgctgccgctgccgcttggggatcatcgtctgaattccggccatggcaagtggcgcttctgataaaaagctctaggaaagaaaccaaccatggcgacttttgttccccccctgcctgctgatcgcgaagccctgcctgcgtccctggttgatggagagaagcctattatttcgccttcaatcaccctccggctggtccccgggggcaaattcatctaacattctgtgtacagtgatggactgatgatggatcaacaaggaggcgtgtggcctttttgttgcttgtgtttgatgtagtagttcttcctctctttcttatggattggatggtgcctgcgcgtacggcgtacccctcaacc

SEQ ID NO: 101 - protein, 355 aa, Panicum virgatum
  misc_feature (1)..(355): Ceres Clone ID no. 1857760
  misc_feature (118)..(331): Pfam Name: Abhydrolase_3 Pfam Description: alpha/beta hydrolase fold
  misc_feature (111)..(157): Pfam Name: COesterase Pfam Description: Carboxylesterase family
  misc_feature (1)..(355): Bit score of 689.8 for HMM based on sequences of Figure 2
  misc_feature (1)..(355): Functional Homolog Of SEQ ID NO. 99
  misc_feature (1)..(355): in Figure 2
MAGSDEVNRNECKTAVPIHTWVLISNFKLAYNMLRRADGTFDRDLAEYLDRRVPPDARAQEGVSSFDHVIDPSVGLEVRIYRAAANNAAGAGAGAAAVTLPILDFLTGAPSPDPFPVILFFHGGSFAHSSSSTAIYDNLCRRFVKLSKGVVLSVNYRRAPEHRYPCAYDDGWAALKWAMSQPFLRSGEGAQPRVFLSGDSSGGNIAHHVAVRAADAGIRICGNILLNAMFGGTERTDSERRLDGKYFVTLQDRDWYWKAYLPEDADRDHPACNPFGPNGRRLRGLPFTKSLIIVSGLDLTCDRQLAYAEGLREDGHHVKLVYREKATIGFYLLPNTDHYHEVMEEISDFLGANLL

SEQ ID NO: 102 - DNA, 1068 bp, Sorghum bicolor
  misc_feature (1)..(1068): Ceres Annot ID no. 8732528
  misc_feature (1)..(1068): Encodes the peptide sequence at SEQ ID NO. 103
atggccggcagcgacgaggtcaaccgcaacgagtgcaagggtgcggtgccgatccacacatgggtgctcatctccaacttcaagctggcgtacaacatgctccggcgggccgacggcaccttcgaccgcgacctcgccgagttcctggaccgccgggtgccgcccgacgcgcgggcccaggagggggtctcctcgttcgaccacgtcatcgacacgtccaccggcctcgaggtccgcatctaccgcgccgccgccgccgccgctaacaacaacggtggcgcggccgcggtcaccctgcccatcctggacttcctcgccggcgcgccgtccccggacccgttcccggtcatcctcttcttccacggcggcagcttcgcgcactcttcctccggcacggccatctacgacaacctgtgccgccggttcgtgaagctgagcaaaggcgtggtggtgtccgtcaactaccgtcgcgccccggagcaccggtacccgtgcgcctacgacgacggctggacggcgctcaagtgggccatgtcgcagcccttcctccgcagcggcaggggcggggacgcccgcccccgcgtcttcctgtcgggcgacagctccggcggcaacatcgcccaccacgttgccgtccgcgccgccgacgccgggatcaacatctgcggcaacatcctgctcaacgccatgttcggcggcacggagcgcaccgagtcggagcggcggctggacggcaagtacttcgtcacgctccaggacagggactggtactggaaggcgtacctgcccgaggacgcggaccgggaccacccggcgtgcaacccgttcgggccgaacgggcggcggctcagggggctacccttcaccaagagcctcatcatcgtgtcgggcctggacctcacctgcgatcggcagctggcgtacgccgagggcctccaggaagatggccaccatgccaagctcgtgtaccgtgagaaggccaccgtgggtttctacctgctgcccaacacggaccactaccacgaggtgatggaggagatcgccgacttcctcagggctaacctctag

SEQ ID NO: 103 - protein, 355 aa, Sorghum bicolor
  misc_feature (1)..(355): Ceres Annot ID no. 8732528
  misc_feature (117)..(332): Pfam Name: Abhydrolase_3 Pfam Description: alpha/beta hydrolase fold
  misc_feature (110)..(156): Pfam Name: COesterase Pfam Description: Carboxylesterase family
  misc_feature (1)..(355): Bit score of 688.6 for HMM based on sequences of Figure 2
  misc_feature (1)..(355): Functional Homolog Of SEQ ID NO. 99
  misc_feature (1)..(355): in Figure 2
MAGSDEVNRNECKGAVPIHTWVLISNFKLAYNMLRRADGTFDRDLAEFLDRRVPPDARAQEGVSSFDHVIDTSTGLEVRIYRAAAAAANNNGGAAAVTLPILDFLAGAPSPDPFPVILFFHGGSFAHSSSGTAIYDNLCRRFVKLSKGVVVSVNYRRAPEHRYPCAYDDGWTALKWAMSQPFLRSGRGGDARPRVFLSGDSSGGNIAHHVAVRAADAGINICGNILLNAMFGGTERTESERRLDGKYFVTLQDRDWYWKAYLPEDADRDHPACNPFGPNGRRLRGLPFTKSLIIVSGLDLTCDRQLAYAEGLQEDGHHAKLVYREKATVGFYLLPNTDHYHEVMEEIADFLRANL

SEQ ID NO: 104 - protein, 354 aa, Hordeum vulgare
  misc_feature (1)..(354): Public GI ID no. 156616217
  misc_feature (1)..(354): Hordeum vulgare subsp. vulgare
  misc_feature (117)..(330): Pfam Name: Abhydrolase_3 Pfam Description: alpha/beta hydrolase fold
  misc_feature (110)..(156): Pfam Name: COesterase Pfam Description: Carboxylesterase family
  misc_feature (1)..(354): Bit score of 690.1 for HMM based on sequences of Figure 2
  misc_feature (1)..(354): Functional Homolog Of SEQ ID NO. 99
  misc_feature (1)..(354): in Figure 2
MAGSDEVNRNECKTVVPLHTWVLISNFKVSYHMLRRPDGTFERDLAEYMDRRVPANPKPVEGVSSFDHVIDHSVGLEARIYRAVAGNAAAAEGAAALTLPILEFLSGAPSPDPLPVIIFFHGGSFAHSASSTTIYDNLCRQLVKLSKGVVVSVNYRRAPEHRYPCAYDDGWTALKWAQAQPFLRSGEDAQPRVFLAGDSSGGNIAHHVAVRAAEEGIKIHGNILLNAMFGGKERTESERRLDGKYFVTMQDRDWYWKAYLPEDADRDHPACNPFGPNGRRLKGLPFAKSLIIVSGLDLTCDRQLGYAEGLREDGHHVKVVHREKATIGFYLLSNTDHYHEVMEEIADFVQLNLR

SEQ ID NO: 105 - protein, 353 aa, Saccharum officinarum
  misc_feature (1)..(353): Public GI ID no. 169159254
  misc_feature (117)..(330): Pfam Name: Abhydrolase_3 Pfam Description: alpha/beta hydrolase fold
  misc_feature (110)..(156): Pfam Name: COesterase Pfam Description: Carboxylesterase family
  misc_feature (1)..(353): Bit score of 691.1 for HMM based on sequences of Figure 2
  misc_feature (1)..(353): Functional Homolog Of SEQ ID NO. 99
  misc_feature (1)..(353): in Figure 2
MAGSDEVNRNECKGAVPIHTWVLISNFKLAYNMLRRADGTFDRDLAEFLDRRVPPDARAQEGVSSFDHVIDTSTGLEVRIYRGAAAANNGAAGAGAVTLPILDFLAGAPSPDPFPVILFFHGGSFAHSSSGTAIYDNLCRRFVKLSKGVVVSVNYRRAPEHRYPCAYEDGWTALKWAMSQPFLRSGADARPRVFLSGDSSGGNIAHHVAVRAADAGISICGNILLNAMFGGTERTESERRLDGKYFVTLQDRDWYWKAYLPEDTDRDHPACNPFGPNGRRLRGLPFTKSLIIVSGLDLTCDRQLAYAEGLQEDGHHVKLVYREKATIGFYLLSNTDHYHEVMEEIADFLRANL

SEQ ID NO: 106 - protein, 355 aa, Triticum aestivum
  misc_feature (1)..(355): Public GI ID no. 169159270
  misc_feature (118)..(331): Pfam Name: Abhydrolase_3 Pfam Description: alpha/beta hydrolase fold
  misc_feature (112)..(157): Pfam Name: COesterase Pfam Description: Carboxylesterase family
  misc_feature (1)..(355): Bit score of 683.8 for HMM based on sequences of Figure 2
  misc_feature (1)..(355): Functional Homolog Of SEQ ID NO. 99
  misc_feature (1)..(355): in Figure 2
MAGSDEVNRNECKTVVPLHTWVLISNFKVSYHMLRRPDGTFERDLAEYMDRRVPANPRPVEGVSSFDHFIDLSVGLEARIYRAVAGNAAGAAEGAAALTLPILEFLGGAPSPDPLPVIIFFHGGSFAHSASSTTIYDNLCRQLVKLSKGVVVSVNYRRAPEHRYPCAYDDGWAALKWAQAQPFLRSGSDARLRVFLAGDSSGGNIAHHVAVRAAEEGIKIHGNILLNAMFGGVERTESERRLDGKYFVTLQDRDWYWKAYLPEDADRDHPACNPFGPNGRRLRGLPFAKSLIIVSGLDLTCDRQLGYAEGLREDGHDVKLVHREKATIGFYLLSNTNHYHEVMEEIAEFVRANLL

SEQ ID NO: 107 - protein, 349 aa, Zea mays
  misc_feature (1)..(349): Public GI ID no. 169159256
  misc_feature (113)..(326): Pfam Name: Abhydrolase_3 Pfam Description: alpha/beta hydrolase fold
  misc_feature (108)..(152): Pfam Name: COesterase Pfam Description: Carboxylesterase family
  misc_feature (1)..(349): Bit score of 682.2 for HMM based on sequences of Figure 2
  misc_feature (1)..(349): Functional Homolog Of SEQ ID NO. 99
  misc_feature (1)..(349): in Figure 2
MAGSDEVNRNECKGAVPIHTWVLISNFKLAYNMLRRADGTFDRDLAEFLDRRVPPDARAQEGVSSSDHVIDTSTGLEVRIYRAAANNGGAGAGAAAVLDFLGGGPSPDPFPVILFFHGGSFAHSSSGTAIYDNLCRRFVKLSKGVVVSVNYRRAPEHRYPCAYDDGWAALKWATSQPFLRSGGDGRPRVFLSGDSSGGNIAHHVAVRAADAGINICGNILLNAMFGGTERTESERRLDGKYFVTLQDRDWYWKAYLPEDADRDHPACNPFGPNGRRLRGLPFPKSLIIVSGLDLTCDRQLAYAEGLQQDGHHVKVVYREKATVGFYLLSNTDHYHEVMEEIGDFLAANL

SEQ ID NO: 108 - protein, 344 aa, Gossypium hirsutum
  misc_feature (1)..(344): Public GI ID no. 225346677
  misc_feature (108)..(321): Pfam Name: Abhydrolase_3 Pfam Description: alpha/beta hydrolase fold
  misc_feature (91)..(147): Pfam Name: COesterase Pfam Description: Carboxylesterase family
  misc_feature (1)..(344): Bit score of 698.3 for HMM based on sequences of Figure 2
  misc_feature (1)..(344): Functional Homolog Of SEQ ID NO. 99
  misc_feature (1)..(344): in Figure 2
MARSNEVNLNECKMVVPLNTWVLISNFKLAYNLLRRPDGTFNRHLAEFLDRKVPANANPVDGVFSFDVLIDRGTSLLSRIYRPTTAEEPRLNIAELEKPVMAAVVPVIIFFHGGSFAHSSANSAIYDTLCRRLVSLCKAVVVSVNYRRAPENRYPCAYDDGWTALKWVNSRPWLQSQKDSKVHIYLAGDSSGGNIAHHVALRAIESGIDILGSILLNPMFGGQERTESEKRLDGKYFVTLRDRDWYWRAYLPEGEDRDHPACNPFGPNGRSLEGIKFPKSLVVVAGLDLIQDWQLAYVEGLKKAGQEVKLLYVEQATIGFYLLPNNHHFHTVMDEISKFVSSDC

SEQ ID NO: 109 - DNA, 1035 bp, Populus trichocarpa
  misc_feature (1)..(1035): Ceres Annot ID no. 1488901
  misc_feature (1)..(1035): Encodes the peptide sequence at SEQ ID NO. 110
atggctggaagtaatggagttaatctcaatgaaagcaagagggtggtacccctgaatacatgggtcctcatatcaaatttcaagctggcttacaatcttcttcgtcgtcctgatgggactttcaaccgccacttggctgagttccttgaccggaaagttcctgctaacgcgaatccagttgatggggttttctcatttgatgttatcattgaccgtgggactagccttcttagccgaatctatagacgagctgatgcgcaagaatcacaaccaaatattgttgaccttgagaagcctgtcaactcggaggttgtccctgtcataatcttctttcatggcggaagctttgctcactcttcttcaaacagtgctatatatgatacactctgtcgccgcctggtgggcctttgcaaggctgtggtagtgtctgtgaattataggcgtgcacctgaaaatcgatacccatgtgcttatgatgatggatggactgctctgaagtgggttaattcaagaacatggctccagagcaagaaagattctaaagttcatatatacttggctggggatagttctggtggtaacattgttcaccatgttgctttaagagcagtagaatcgggaattgatgttttgggaaacatactgctgaacccaatgtttggtgggcaagagagaacagaatcagagaagcgattagatggcaaatattttgttactctccaagaccgagactggtattggagagcatttcttcctgaaagagaggatagggaccatccagcatgtaatccatttggtccaaaaggtaaaagcctcgaaggaattaaatttcctaagagtcttgttgtggtggccggtttagaccttgttcacgaccggcaaataacatatgctgaaggtctcaagaaggctggtcaagatgtgaaacttctgtatctggagcaggcaacaataggtttctacttgttgcccaataacaattacttccatacagtgatggatgagataagtgaattcgtgagtcctaactgttaa

SEQ ID NO: 110 - protein, 344 aa, Populus trichocarpa
  misc_feature (1)..(344): Ceres Annot ID no. 1488901
  misc_feature (108)..(321): Pfam Name: Abhydrolase_3 Pfam Description: alpha/beta hydrolase fold
  misc_feature (92)..(147): Pfam Name: COesterase Pfam Description: Carboxylesterase family
  misc_feature (1)..(344): Bit score of 694.6 for HMM based on sequences of Figure 2
  misc_feature (1)..(344): Functional Homolog Of SEQ ID NO. 99
  misc_feature (1)..(344): in Figure 2
MAGSNGVNLNESKRVVPLNTWVLISNFKLAYNLLRRPDGTFNRHLAEFLDRKVPANANPVDGVFSFDVIIDRGTSLLSRIYRRADAQESQPNIVDLEKPVNSEVVPVIIFFHGGSFAHSSSNSAIYDTLCRRLVGLCKAVVVSVNYRRAPENRYPCAYDDGWTALKWVNSRTWLQSKKDSKVHIYLAGDSSGGNIVHHVALRAVESGIDVLGNILLNPMFGGQERTESEKRLDGKYFVTLQDRDWYWRAFLPEREDRDHPACNPFGPKGKSLEGIKFPKSLVVVAGLDLVHDRQITYAEGLKKAGQDVKLLYLEQATIGFYLLPNNNYFHTVMDEISEFVSPNC

SEQ ID NO: 111 - protein, 344 aa, Ricinus communis
  misc_feature (1)..(344): Public GI ID no. 255542494
  misc_feature (108)..(321): Pfam Name: Abhydrolase_3 Pfam Description: alpha/beta hydrolase fold
  misc_feature (92)..(147): Pfam Name: COesterase Pfam Description: Carboxylesterase family
  misc_feature (1)..(344): Bit score of 696.8 for HMM based on sequences of Figure 2
  misc_feature (1)..(344): Functional Homolog Of SEQ ID NO. 99
  misc_feature (1)..(344): in Figure 2
MAGSNEVNLNESKMVVPLNTWVLISNFKLAYNLLRRPDGTFNRHLAEFLDRKVPPNANPVDGVFSFDVVIDRGTSLLSRIYRPAEGEQLQPNIAELEKPVTSDVVPVILFFHGGSFAHSSANSAIYDTLCRRLVGICRAVVVSVNYRRAPENRYPCAYDDGWTALKWVNSRTWLESKKDAKVHMYLAGDSSGGNIVHHVALRALESGIEVLGNILLNPMFGGQERTESEKRLDGKYFVTVQDRDWYWRAFLPEEADRDHPACNPFGPKGRSLEGMKFPKSLVVVAGLDLIQDWQLAYVEGLKKAGQVVKLLYLEQATIGFYLLPNNNHFHTVMDEISEFVCPNC

SEQ ID NO: 112 - protein, 344 aa, Vitis vinifera
  misc_feature (1)..(344): Public GI ID no. 225436847
  misc_feature (108)..(321): Pfam Name: Abhydrolase_3 Pfam Description: alpha/beta hydrolase fold
  misc_feature (79)..(150): Pfam Name: COesterase Pfam Description: Carboxylesterase family
  misc_feature (1)..(344): Bit score of 697.6 for HMM based on sequences of Figure 2
  misc_feature (1)..(344): Functional Homolog Of SEQ ID NO. 99
  misc_feature (1)..(344): in Figure 2
MAGSDEVNHNESKRVVPLNTWILISNFKLAYNLLRRPDGTFERELAEFLERKAPANSFPVDGVFSFDIVDKTTGLLNRVYQPAPENEAQWGIIELEKPLSTTEIVPVILFFHGGSFTHSSANSAIYDYFCRRLVGNCKAVVVSVNYRRSPEHRYPCAYDDGWAALKWVKSRSWLQSGKDSKVHVYLAGDSSGGNITHHVAVRAAESGIEVLGNILLHPMFGGQERTESEKRLDGKYFVTIQDRDWYWRAFLPEGEDRDHPACNPFGPRGKSLEGLNFPKSLVVVAGFDLVQDWQLAYVEGLKKAGQDVNLLFLEQATIGFYFLPNNDHFYCLMEEIKNFVKSNC

SEQ ID NO: 113 - protein, 358 aa, Brassica napus
  misc_feature (1)..(358): Public GI ID no. 315075933
  misc_feature (108)..(321): Pfam Name: Abhydrolase_3 Pfam Description: alpha/beta hydrolase fold
  misc_feature (104)..(201): Pfam Name: COesterase Pfam Description: Carboxylesterase family
  misc_feature (1)..(358): Bit score of 681.9 for HMM based on sequences of Figure 2
  misc_feature (1)..(358): Functional Homolog Of SEQ ID NO. 99
  misc_feature (1)..(358): in Figure 2
MAGGNEVNLNECKRIVPLNTWVLISNFKLAYTLLRRPDGSFNRDLAEFLDRKVPANSFPVDGVFSFDHVDTSTSLLTRIYLPAPLDPSRHGSVDLTEPLSTTDIVPVLVFFHGGSFTHSSANSAIYDTFCRRLVTICGVVVVSVDYRRSPEHRYPCAYDDGWNALKWVKSRVWLQSGKDSNVYVYLAGDSSGGNIAHNVAVRATNEGVKVLGNILLHPMFGGLERTQSEKRLDGKYFVTIHDRDWYWRAYLPEGEDRDHPACNPFGPRGQSLEGVNFPKSLVVVAGLDLVQDWQLAYVDGLKRTGHHVNLLYLKQATIGFYFLPNNDHFHCLMDELTKFVHSIDEDSQSKSSPVLLTP

SEQ ID NO: 114 - protein, 342 aa, Cucurbita maxima
  misc_feature (1)..(342): Public GI ID no. 238654635
  misc_feature (108)..(321): Pfam Name: Abhydrolase_3 Pfam Description: alpha/beta hydrolase fold
  misc_feature (97)..(149): Pfam Name: COesterase Pfam Description: Carboxylesterase family
  misc_feature (1)..(342): Bit score of 686.3 for HMM based on sequences of Figure 2
  misc_feature (1)..(342): Functional Homolog Of SEQ ID NO. 99
  misc_feature (1)..(342): in Figure 2
MAGSNEVNLNESKRVVPLNTWVLISNFKLAYTILRRSDGTFNRELAEYLERKVPANVNPVDGVFSFDNVDRASGLLNRVYQPAPDNEARWGIIDLEKPLSKSKVVPVILFFHGGSFAHSSANSAIYDTFCRRIVSVCKAVVVSVNYRRSPEFRYPCAYEDGWTALKWVKSKKWLQSGKDSKVHVYLAGDSSGGNIAHHVAARAAEEDIEVLGNILLHPMFGGEKRTESEKKLDGKYFVTIQDRDWYWKAYLPEGEDRDHPACNIFGPKAKSLEGINFPKSLVVVAGLDLMQDWQLAYVQGLKNSGHDVKLLFLEQATIGFYFLPNNEHFYCLMEEIDNFINP

SEQ ID NO: 115 - protein, 346 aa, Actinidia deliciosa
  misc_feature (1)..(346): Public GI ID no. 82697973
  misc_feature (110)..(323): Pfam Name: Abhydrolase_3 Pfam Description: alpha/beta hydrolase fold
  misc_feature (102)..(152): Pfam Name: COesterase Pfam Description: Carboxylesterase family
  misc_feature (1)..(346): Bit score of 685.8 for HMM based on sequences of Figure 2
  misc_feature (1)..(346): Functional Homolog Of SEQ ID NO. 99
  misc_feature (1)..(346): in Figure 2
MAGSNEINVNESKKVVPLNTWILISNFKLAYNMLRRPDGTFNRDLAEFLERKVPPNAIPVDGVFSFDVVDSSTSLLNRIYRPSPETEANSQFGIDDLQKPLSTTEIVPVIIFFHGGSFTHSSANSAIYDTFCRRLVSICKAVVVSVNYRRSPENRYPSAYDDGWAALKWVHSRPWLHSGKDSKAYVYLAGDSSGGTIAHHVAHRAAESGVEVLGNILLHPMFGGQERTESEKKLDGKYFVTIQDRDWYWRAYLPEGEDRDHPACNPFGPRGVSLEGLSFPKSLVVVAGLDLVQDWQLAYVEGLKNAGQEVKLLFLKQATIGFYFLPNNDHFYYLMEEINSFVNPNC

SEQ ID NO: 116 - protein, 519 aa, Oryza sativa
  misc_feature (1)..(519): Public GI ID no. 218196784
  misc_feature (1)..(519): Oryza sativa Indica Group
  misc_feature (116)..(226): Pfam Name: Abhydrolase_3 Pfam Description: alpha/beta hydrolase fold
  misc_feature (102)..(152): Pfam Name: COesterase Pfam Description: Carboxylesterase family
  misc_feature (1)..(519): Bit score of 396.0 for HMM based on sequences of Figure 2
  misc_feature (1)..(519): Functional Homolog Of SEQ ID NO. 99
MAGSDEVNRNECKTVVPLHTWVLISNFKLSYNILRRADGTFERDLGEYLDRRVPANARPLEGVSSFDHIIDQSVGLEVRIYRAAAEGDAEEGAAAVTRPILEFLTDAPATEPFPVIIFFHGGSFVHSSASSTIYDSLCRRFVKLSKGVVVSVNYRRAPEHRYPCAYDDGWTALKWVMSQPFMRSGGDAQARVFLSGDSSGGNIAHHVAVRAADEGVKTVVPLHTWVLISNFKLSYNILRRADGTFERDLGEYLDRRVPANARPLEGVSSFDHIIDQSVGLEVRIYRAAAEGDAEEGAAAVTRPILEFLTDAPATEPFPVIIFFHGGSFVHSSASSTIYDSLCRRFVKLSKGVVVSVNYRRAPEHRYPCAYDDGWTALKWVMSQPFMRSGGDAQARVFLSGDSSGGNIGHHVAVRADDEGVKAYLPEDADRDHPACNPFGPNARRLGGLPFAKSLIIVSGLDLTCDRQLAYADALREDGHHVKVVQCENATVGFYLLPNTVHYHEVMEEISDFLNANLYY

SEQ ID NO: 117 - protein, 350 aa, Zea mays
  misc_feature (1)..(350): Public GI ID no. 169159258
  misc_feature (114)..(327): Pfam Name: Abhydrolase_3 Pfam Description: alpha/beta hydrolase fold
  misc_feature (107)..(153): Pfam Name: COesterase Pfam Description: Carboxylesterase family
  misc_feature (1)..(350): Bit score of 652.4 for HMM based on sequences of Figure 2
  misc_feature (1)..(350): Functional Homolog Of SEQ ID NO. 99
MAGSDEVNRNECKGAVPIHTWVLISNFKLAYNMLRRADGTFDRDLAEFLDRRVAPDARAQEGVSSFDHVIDTSTGLEVRIYRAAANNNGGGGATLPILDFLGGTPAASTPFPVILFFHGGSFAHSSSGTAIYDNLCRRLVRLSKGVVVSVNYRRAPEHRYPCAYDDGWAALKWATSQPSLGSGSSGGARVFLSGDSSGGNIAHHVAVRAAVAGIRVRGNVLLNAMFGGAERTESERRLDGKYFVTLQDRDWYWKAYLPEDADRDHPACNPFGPNGRRLAGLPFPRSLIIVSGLDLTCDRQLAYADGLREDGHPVKLVYREKATVGFYLLPNTNHYHEVMEEIADFLRANL

SEQ ID NO: 118 - DNA, 1854 bp, Gossypium hirsutum
  misc_feature (1)..(1854): Ceres Clone ID no. 1941624
  misc_feature (1)..(1854): Encodes the peptide sequence at SEQ ID NO. 119
gtgagatttatcattttattgttcactctgtttttctgctctcttatgaacttataattaagccaaaaagaaaaaaaaaaggttttagtgaatttgataatgagctgaacagcagaaaaaagagggatctttggagtggaaaatagaataagaatagaatctttgttgtttgtttcttctttaaaaaaaaaaacaaaattggttttgtgatatgaattgtgggtttctgggttgttcttcgaaaggatctgtttgaagctttggggttttgtttttgagtctttaaagaaggggggaaatggctagaagtaatgaagtcaacctcaatgaatgcaagatggtggttcccctaaatacgtgggtcctcatctccaactttaagttggcttacaatcttcttcgtcgacctgatggcactttcaatcgtcacttggcagagtttcttgatcgcaaagtccctgctaatgctaacccagttgatggggttttctcgtttgatgttctcattgatcgtggtacgagcctcctgagtcggatttataggccaactacagctgaagagcctcaaccgaatattgctgaacttgagaaacctgttacagcggcggtggtccctgttattattttctttcatggtggaagctttgcacattcctcggctaatagtgctatatatgacactctatgtcggagattggtaaggctttgtaaggctgttgtggtctccgtgaattatcgccgtgcacctgaaaatagatatccgtgtgcttatgatgatgggtggactgctctcaaatgggttaactctagaccatggcttcaaagtcaaaaagattctaaggttcatatatatctagccggagatagctctggtggtaacattgcacaccatgttgctctgcgagccatagaatcaggaattgatatattgggaagtatattgctcaatccaatgtttggtggacaagaaagaactgaatctgaaaagcgtttagatgggaaatactttgttactctacgagatcgggactggtattggagagcttatcttcctgaaggtgaagacagagatcatcctgcatgtaacccttttggacctaacggtagaagtctcgagggaatcaaatttccaaagagtcttgtcgtggttgccggcttggaccttattcaggattggcaattggcttatgttgaagggctcaaaaaagctggacaagaggttaaacttttatacatggaacaggccacgattggtttctacttgttgccgaataaccatcacttccatactgttatggacgagataagcaaattcgtgagttctgactgttaatagaattaacctgacctacaggccgccataaacgacaggagcttgacattcctccacttgtggcaaccaacaagtttgcagtttatgattgtgtagtattactagttagtgtcttattaatgctggtattattttgctccatattttcggactaccgagcttgattaaagaagaggtattccagcgcatagctggatcaggatctgttctggtctgcattcactcgcctggacttgagtgttatagttcgatgaagctcttgtttcagttagagcctttttgactatgttttagcagactaagtttaagagttacaaattctggcttcttgccacaaaggagaagaagacaggaatatatggataacattcggtaaccgatcaagggatcggtgtctggctaatgttatatatatataaatatatatgctaattttagaacatggattagagagttctccatggcttttatgaccctgtatgtttatacatatgtgttagtatatataaagatgtttgctt

SEQ ID NO: 119 - protein, 344 aa, Gossypium hirsutum
  misc_feature (1)..(344): Ceres Clone ID no. 1941624
  misc_feature (108)..(321): Pfam Name: Abhydrolase_3 Pfam Description: alpha/beta hydrolase fold
  misc_feature (82)..(147): Pfam Name: COesterase Pfam Description: Carboxylesterase family
  misc_feature (1)..(344): Bit score of 698.7 for HMM based on sequences of Figure 2
  misc_feature (1)..(344): Functional Homolog Of SEQ ID NO. 99
MARSNEVNLNECKMVVPLNTWVLISNFKLAYNLLRRPDGTFNRHLAEFLDRKVPANANPVDGVFSFDVLIDRGTSLLSRIYRPTTAEEPQPNIAELEKPVTAAVVPVIIFFHGGSFAHSSANSAIYDTLCRRLVRLCKAVVVSVNYRRAPENRYPCAYDDGWTALKWVNSRPWLQSQKDSKVHIYLAGDSSGGNIAHHVALRAIESGIDILGSILLNPMFGGQERTESEKRLDGKYFVTLRDRDWYWRAYLPEGEDRDHPACNPFGPNGRSLEGIKFPKSLVVVAGLDLIQDWQLAYVEGLKKAGQEVKLLYMEQATIGFYLLPNNHHFHTVMDEISKFVSSDC

SEQ ID NO: 120 - protein, 344 aa, Gossypium hirsutum
  misc_feature (1)..(344): Public GI ID no. 225346675
  misc_feature (108)..(321): Pfam Name: Abhydrolase_3 Pfam Description: alpha/beta hydrolase fold
  misc_feature (80)..(147): Pfam Name: COesterase Pfam Description: Carboxylesterase family
  misc_feature (1)..(344): Bit score of 687.8 for HMM based on sequences of Figure 2
  misc_feature (1)..(344): Functional Homolog Of SEQ ID NO. 99
MAGSNEVNLNECKMVVPLNTWVLISSFKLAYNLLRRPDGTFNRHLAEFLDRKVPANLNPVDGVFSFDVLIDRATGLLCRIYRPATAEEPEPNIVELEKPVVGDVVPVIIFFHGGSFAHSSADSAIYDTLCRRLVGICKAVVVSVNYRRAPENRYPCAYDDGWTAFKWVNSRSWLQSRKDSKVHIYLAGDSSGGNIAHHVAARAVESGIDVLGNILLNPMFGGQERTESEKRLDGKYFVTLRDRDWYWRAFLPEGENRDHPACNPFGPNGRSLEGIKFPKSLVVVAGLDLIQDWQLAYVEGLRKAGKEVKLLYMEQATIGFYLLPNNNHFHTVMDEISEFVSSDC

SEQ ID NO: 121 - protein, 344 aa, Gossypium hirsutum
  misc_feature (1)..(344): Public GI ID no. 148612415
  misc_feature (108)..(321): Pfam Name: Abhydrolase_3 Pfam Description: alpha/beta hydrolase fold
  misc_feature (80)..(198): Pfam Name: COesterase Pfam Description: Carboxylesterase family
  misc_feature (1)..(344): Bit score of 691.5 for HMM based on sequences of Figure 2
  misc_feature (1)..(344): Functional Homolog Of SEQ ID NO. 99
MAGSNEVNLNESKRVVPLNTWVLISNFKLSYNLQRRPDGTFNRDLSEFLDRRVPANINPVDGVFSFDHVDGATGLLNRVYQPSPKNEAQWGIVDLEKPLSTTEVVPVIVFFHGGSFTHSSANSAIYDTFCRRLVNICKAVVVSVNYRRSPEHRYPCAYDDGWAALKWVKSRTWLQSGKDSKVHVYLAGDSSGGNIAHHVAVRAAEADVEVLGNILLHPMFGGQMRTESEKRLDGKYFVTLHDRDWYWRAYLPEGEDRDHPACNPFGPRGRTLEGLKFPKSLVVVAGLDLIQDWQLAYVEGLKKSGQEVKLLFLEKATIGFYFLPNNDHFYRLMEEMNNFVHSNC

SEQ ID NO: 122 - DNA, 1035 bp, Populus trichocarpa
  misc_feature (1)..(1035): Ceres Annot ID no. 1522790
  misc_feature (1)..(1035): Encodes the peptide sequence at SEQ ID NO. 123
atggctggaagtaatgaagtcaatctcaatgaaagcaagatggtggtacccctgaacacatgggtcctcatatcaaatttcaagctggcttacaatcttcttcgtcgtcctgatgggactttcaaccgccacttggcagagttccttgaccggaaagttcctgccaacgcaaatgcagttgatggggttttctcatttgatgttatcattgaccgtgggactagtcttcttagccggatctatcgacaggctgatgcgcaagtatcacaaccaaatattgttgaccttgagaagcctaacaacttggatgttgtccctgtcataatcttctttcatggtggaagctttgctcactcttctgcaaacagtgctatatatgatacactctgtcgccgcctggtgggcctttgcaaggctgtggtagtgtctgtgaattataggcgtgcacctgaaaatcgatacccatgtgcttatgatgatggatggactgctctgaagtgggttaattcaagggcatggctccagagtaagaaagactctaaagttcatatatacttggctggggatagctctggtggtaacattgttcaccatgttgcttcaagagcagtagaatcaggaattgaagtattgggcaacatgctgctgaacccaatgtttggtgggaaagagagaacagaatcggagaagcgattagatggcaaatattttgtaactctccaggaccgagattggtactggagagcatttcttcctgaaggagaagatagggaccatccagcatgtaatccatttggtccaaaaggtaaaagccttgagggaatgaaattccccaagagtcttgttgtggtggctggtttagatcttgttcaggactggcaattggcatatgctgaaggtctcaagaaggctggtcaagatgtgaaacttttatatctggagcaagcaacaatagggttctacttgttacccaataacaatcacttccatacagtgatgaatgagataagtgaatttgtgagtcctaactgttaa

SEQ ID NO: 123 - protein, 344 aa, Populus trichocarpa
  misc_feature (1)..(344): Ceres Annot ID no. 1522790
  misc_feature (108)..(321): Pfam Name: Abhydrolase_3 Pfam Description: alpha/beta hydrolase fold
  misc_feature (98)..(148): Pfam Name: COesterase Pfam Description: Carboxylesterase family
  misc_feature (1)..(344): Bit score of 693.7 for HMM based on sequences of Figure 2
  misc_feature (1)..(344): Functional Homolog Of SEQ ID NO. 99
MAGSNEVNLNESKMVVPLNTWVLISNFKLAYNLLRRPDGTFNRHLAEFLDRKVPANANAVDGVFSFDVIIDRGTSLLSRIYRQADAQVSQPNIVDLEKPNNLDVVPVIIFFHGGSFAHSSANSAIYDTLCRRLVGLCKAVVVSVNYRRAPENRYPCAYDDGWTALKWVNSRAWLQSKKDSKVHIYLAGDSSGGNIVHHVASRAVESGIEVLGNMLLNPMFGGKERTESEKRLDGKYFVTLQDRDWYWRAFLPEGEDRDHPACNPFGPKGKSLEGMKFPKSLVVVAGLDLVQDWQLAYAEGLKKAGQDVKLLYLEQATIGFYLLPNNNHFHTVMNEISEFVSPNC

SEQ ID NO: 124 - protein, 344 aa, Gossypium hirsutum
  misc_feature (1)..(344): Public GI ID no. 110747150
  misc_feature (108)..(321): Pfam Name: Abhydrolase_3 Pfam Description: alpha/beta hydrolase fold
  misc_feature (99)..(199): Pfam Name: COesterase Pfam Description: Carboxylesterase family
  misc_feature (1)..(344): Bit score of 690.2 for HMM based on sequences of Figure 2
  misc_feature (1)..(344): Functional Homolog Of SEQ ID NO. 99
MAGSNEVNLNESKRVVPLNTWVLISNFKLAYNLQRRPDGTFNRDLSEFLDRRVPANINPVDGVFSFDHVDGATGLLNRVYQPSSLNEAQWGMVDLEKPLSTTEIVPVIVFFHGGSFTHSSANSAIYDTFCRRLVSLCKAVVVSVNYRRSPEHRYPCAYDDGWAALKWVKSRTWLQSGKDSNVHVYLAGDSSGGNIAHHVAVRAAEADVEVLGDILLHPMFGGQKRTESEKRLDGKYFVTLHDRDWYWRAYLPEGEDRDHPACNPFGPRGRSLEGLKFPKSLVVVAGLDLIQDWQLAYVEGLKKSGQEVNLLFLEKATIGFYFLPNNNHFYCLMEEIKNFVNPNC

SEQ ID NO: 125 - DNA, 1236 bp, Populus trichocarpa
  misc_feature (1)..(1236): Ceres Annot ID no. 1469390
  misc_feature (1)..(1236): Encodes the peptide sequence at SEQ ID NO. 126
atggctggaagtaatgaagtcaatctcaatgaaagcaagatggtggtacccctgaacacatgggtcctcatatcaaatttcaagctggcttacaatcttcttcgtcgtcctgatgggactttcaaccgccacttggcagagttccttgaccggaaagttcctgccaacgcaaatgcagttgatggggttttctcatttgatgttatcattgaccgtgggactagtcttcttagccggatctatcgacaggctgatgcgcaagtatcacaaccaaatattgttgaccttgagaagcctaacaacttggatgttgtccctgtcataatcttctttcatggtggaagctttgctcactcttctgcaaacagtgctatatatgatacactctgtcgccgcctggtgggcctttgcaaggctgtggtagtgtctgtgaattataggcgtgcacctgaaaatcgatacccatgtgcttatgatgatggatggactgctctgaagtgggttaattcaagggcatggctccagagtaagaaagactctaaagttcatatatacttggctggggatagctctggtggtaacattgttcaccatgttgcttcaagagcagtagaatcaggaattgaagtattgggcaacatgctgctgaacccaatgtttggtgggaaagagagaacagaatcggagaagcgattagatggcaaatattttgtaactctccaggaccgagattggtactggagagcatttcttcctgaaggagaagatagggaccatccagcatgtaatccatttggtccaaaaggtaaaagccttgagggaatgaaattccccaagagtcttgttgtggtggctggtttagatcttgttcaggactggcaattggcatatgctgaaggtctcaagaaggctggtcaagatgtgaaacttttatatctggagcaagcaacaatagggttctacttgttacccaataacaatcacttccatacagtgatgaatgagataagtgaatttatgactcaagcttgcggaagacctgcagctcctgttttatttcttgaagacactttgcaaggcacagtacgcttctggagttctaaccaaaagcaaagtgggcaacatggagtgctattgctacagttaattgtacttcctaccttgaattatgaagctatacaagatgctagaatgaacgaagagataaaaacaaaggtgcctgaagcactgcactga

SEQ ID NO: 126 - protein, 411 aa, Populus trichocarpa
  misc_feature (1)..(411): Ceres Annot ID no. 1469390
  misc_feature (108)..(321): Pfam Name: Abhydrolase_3 Pfam Description: alpha/beta hydrolase fold
  misc_feature (98)..(148): Pfam Name: COesterase Pfam Description: Carboxylesterase family
  misc_feature (1)..(411): Bit score of 690.1 for HMM based on sequences of Figure 2
  misc_feature (1)..(411): Functional Homolog Of SEQ ID NO. 99
MAGSNEVNLNESKMVVPLNTWVLISNFKLAYNLLRRPDGTFNRHLAEFLDRKVPANANAVDGVFSFDVIIDRGTSLLSRIYRQADAQVSQPNIVDLEKPNNLDVVPVIIFFHGGSFAHSSANSAIYDTLCRRLVGLCKAVVVSVNYRRAPENRYPCAYDDGWTALKWVNSRAWLQSKKDSKVHIYLAGDSSGGNIVHHVASRAVESGIEVLGNMLLNPMFGGKERTESEKRLDGKYFVTLQDRDWYWRAFLPEGEDRDHPACNPFGPKGKSLEGMKFPKSLVVVAGLDLVQDWQLAYAEGLKKAGQDVKLLYLEQATIGFYLLPNNNHFHTVMNEISEFMTQACGRPAAPVLFLEDTLQGTVRFWSSNQKQSGQHGVLLLQLIVLPTLNYEAIQDARMNEEIKTKVPEALH

SEQ ID NO: 127 - protein, 344 aa, Gossypium hirsutum
  misc_feature (1)..(344): Public GI ID no. 225346679
  misc_feature (108)..(321): Pfam Name: Abhydrolase_3 Pfam Description: alpha/beta hydrolase fold
  misc_feature (90)..(147): Pfam Name: COesterase Pfam Description: Carboxylesterase family
  misc_feature (1)..(344): Bit score of 679.4 for HMM based on sequences of Figure 2
  misc_feature (1)..(344): Functional Homolog Of SEQ ID NO. 99
MARSNEVKLNECKMAVSLSTWVLISNFKLAYNLLRRPDGTFNRHLAEFLDRKVPANANPVDGVFSFDVLIDRGTSLLSRIYRPATAEEPQPNIAELEKPVTAEVVPVIIFFHGGSFAHSSANSATYDTLCRRLVSLCKAVVVSVNYRRAPENRYPCAYDDGWTALKWVNSRPWLQSQKDSKVHIYLAGDSSGGNIAHHVALRAIESGIDVLGNILLNPMFGGQERTESEKRLDGKYCVTLRDRDWYWRAYLPEGEDRDHPACNPFGPNGRSLEGIKFPKSLVVVAGLDLIQDWQLAYVEGLKKAGQEVKLLYMEQATIGFFLLPNSNHFHTVTDEITKFVSSDC

SEQ ID NO: 128 - protein, 344 aa, Populus trichocarpa
  misc_feature (1)..(344): Public GI ID no. 224068739
  misc_feature (108)..(321): Pfam Name: Abhydrolase_3 Pfam Description: alpha/beta hydrolase fold
  misc_feature (89)..(149): Pfam Name: COesterase Pfam Description: Carboxylesterase family
  misc_feature (1)..(344): Bit score of 688.2 for HMM based on sequences of Figure 2
  misc_feature (1)..(344): Functional Homolog Of SEQ ID NO. 99
MAGSNEVNLNESKRVVPLNTWVLISNFKLAYNLLRRPDGTFNRELAEFLERKVQANTIPVDGVFSFDHVDRTTGLLNRVYQPAPESEAQWGIVELEKPLNTTEVVPVIIFFHGGSFTHSSANSAIYDTFCRRLVSACKAVVVSVNYRRSPEYRYPCAYDDGWTALKWVKSRTWLQSGKDSKVHVYLAGDSSGGNIAHHVAARAAEEEIDVLGNILLHPMFGGQQRTESEKILDGKYFVTIQDRDWYWRAYLPEGEDRDHPACNIFGPRGKKLEGLEFPKSLVVVAGFDLVQDWQLAYVEGLQRAGHEVKLLYLKQATIGFYFLPNNDHFYCLMEEIKKFVNSNC

SEQ ID NO: 129 - protein, 344 aa, Gossypium hirsutum
  misc_feature (1)..(344): Public GI ID no. 225346671
  misc_feature (108)..(321): Pfam Name: Abhydrolase_3 Pfam Description: alpha/beta hydrolase fold
  misc_feature (80)..(198): Pfam Name: COesterase Pfam Description: Carboxylesterase family
  misc_feature (1)..(344): Bit score of 684.1 for HMM based on sequences of Figure 2
  misc_feature (1)..(344): Functional Homolog Of SEQ ID NO. 99
MAGSNEVNLNESKRVVPLNTWVLISNFKLSYNLQRRPDGTFNRDLSEFLDRRVPANINPVDGVFSFDRADGATGLLNRVYQPSPKNEAQWGIVDLEKPLSTTEIVPVIVFFHGGSFTHSSANSAIYDTFCRRLVNICKAVVVSVNYRRSPEHRYPCAYDDGWAALKWVKSRTWLQSGKDSKVHVYLAGDSSGGNIAHHVAVRAAEADVEVLGNILLHPMFGGQMRTESEKRLDGKYFVTLHDRDWYWRAYLPEGEDRDHPACNPFGPRGRTLEGLKSPKSLVVVAGLDLIQDWQLAYVEGLKKSGQEVKLLFLEKATIGFYFLPNNDHFYCLMEEMNNFVHSNC

SEQ ID NO: 130 - DNA, 1035 bp, Populus trichocarpa
  misc_feature (1)..(1035): Ceres Annot ID no. 1471748
  misc_feature (1)..(1035): Encodes the peptide sequence at SEQ ID NO. 131
atggctggtagcaatgaagtcaacctcaacgaatccaagagggttgttccgctaaacacatggatcctcatttccaatttcaagcttgcatataatctccttcgccgcccggatgggacctttaaccgcgaattggcggagttccttgaacgaaaagtccaggccaacaccattccagtgaatggagttttctcctttgatcatgttgatcgcaccacaggcctccttaaccgggtttaccaacctgcccctgaaaacgaggctcaatggggcattgcagagcttgaaaagcccttgagcactacggaggttgttccagttataatcttcttccatggtggaagctttactcattcctctgctgatagtgctatctatgacaccttctgtcgccgccttgtcagcgtttgcaaggctgttgtggtgtccgtcaattatcgtcgatcgcccgagtatcggtacccttgtgcatatgatgatggctggacagctctcaaatgggttaaatctaggacctggcttcaaagtggaaaggattctaaggttcatgtctatttggccggcgatagttcaggcggtaatatagctcaccatgttgccgtgagggcagcggaagaagaaatcgaggtgttgggtaatattcttctccacccaatgtttggtggacaacagagaacagaatcagagaagatgttagatggcaagtacttcgtcacgattcaagaccgcgactggtattggagagcatatctacctgaaggagaagatagggaccatccagcgtgtaatatatttggtccgaggggcaaaaatcttgagggactggagttccctagaagtctagttgttgtggctggtttcgatcttgttcgagattggcaattggcctatgttgaaggactccagagagccggttatgaagtaaaactcctgtatctaaaagaggccactatagggttctatttcttgccaaataatgaacacttctgctgtctcatggaggagataaagaagttcgtgaattctaactgttaa

SEQ ID NO: 131 - protein, 344 aa, Populus trichocarpa
  misc_feature (1)..(344): Ceres Annot ID no. 1471748
  misc_feature (108)..(321): Pfam Name: Abhydrolase_3 Pfam Description: alpha/beta hydrolase fold
  misc_feature (79)..(149): Pfam Name: COesterase Pfam Description: Carboxylesterase family
  misc_feature (1)..(344): Bit score of 679.9 for HMM based on sequences of Figure 2
  misc_feature (1)..(344): Functional Homolog Of SEQ ID NO. 99
MAGSNEVNLNESKRVVPLNTWILISNFKLAYNLLRRPDGTFNRELAEFLERKVQANTIPVNGVFSFDHVDRTTGLLNRVYQPAPENEAQWGIAELEKPLSTTEVVPVIIFFHGGSFTHSSADSAIYDTFCRRLVSVCKAVVVSVNYRRSPEYRYPCAYDDGWTALKWVKSRTWLQSGKDSKVHVYLAGDSSGGNIAHHVAVRAAEEEIEVLGNILLHPMFGGQQRTESEKMLDGKYFVTIQDRDWYWRAYLPEGEDRDHPACNIFGPRGKNLEGLEFPRSLVVVAGFDLVRDWQLAYVEGLQRAGYEVKLLYLKEATIGFYFLPNNEHFCCLMEEIKKFVNSNC

SEQ ID NO: 132 - protein, 344 aa, Vitis vinifera
  misc_feature (1)..(344): Public GI ID no. 147774750
  misc_feature (108)..(321): Pfam Name: Abhydrolase_3 Pfam Description: alpha/beta hydrolase fold
  misc_feature (104)..(147): Pfam Name: COesterase Pfam Description: Carboxylesterase family
  misc_feature (1)..(344): Bit score of 674.3 for HMM based on sequences of Figure 2
  misc_feature (1)..(344): Functional Homolog Of SEQ ID NO. 99
MAGSNEVNLSESKRVVPLNTWILISNFKLAYNLLRRPDGTFNRHLAEFLDRKVPANANPVEGVFSFDVIIDRSTSLLSRIYRPATGEEALPSIMELEKPVTGDIVPVILFFHGGSFAHSSANSAIYDTLCRRLVGICKAVVVSVNYRRAPENPYPCAYDDGWAALKWVNSRPWLKSEEDSKVHIYMVGDSSGGNIVHNVALKAVESGIEVLGNILLNPMFGGQERTESEKRLDGKYFVTIQDRDWYWRAFLPEGEDRDHAACNPFGPNGKSLVGMKFPKSLVVVAGLDLVQDWQLAYVEGLKKAGQEVKHLYLDKATIGFYLLPNNDHFYTVMDEISNFVSSNC

SEQ ID NO: 133 - protein, 344 aa, Arabidopsis thaliana
  misc_feature (1)..(344): Public GI ID no. 15240483
  misc_feature (107)..(320): Pfam Name: Abhydrolase_3 Pfam Description: alpha/beta hydrolase fold
  misc_feature (103)..(146): Pfam Name: COesterase Pfam Description: Carboxylesterase family
  misc_feature (1)..(344): Bit score of 655.2 for HMM based on sequences of Figure 2
  misc_feature (1)..(344): Functional Homolog Of SEQ ID NO. 99
MAGSEEVNLIESKTVVPLNTWVLISNFKLAYNLLRRPDGTFNRHLAEFLDRKVPANANPVNGVFSFDVIIDRQTNLLSRVYRPADAGTSPSITDLQNPVDGEIVPVIVFFHGGSFAHSSANSAIYDTLCRRLVGLCGAVVVSVNYRRAPENRYPCAYDDGWAVLKWVNSSSWLRSKKDSKVRIFLAGDSSGGNIVHNVAVRAVESRIDVLGNILLNPMFGGTERTESEKRLDGKYFVTVRDRDWYWRAFLPEGEDREHPACSPFGPRSKSLEGLSFPKSLVVVAGLDLIQDWQLKYAEGLKKAGQEVKLLYLEQATIGFYLLPNNNHFHTVMDEIAAFVNAECQ

SEQ ID NO: 134 - protein, 345 aa, Gossypium hirsutum
  misc_feature (1)..(345): Public GI ID no. 225346673
  misc_feature (108)..(321): Pfam Name: Abhydrolase_3 Pfam Description: alpha/beta hydrolase fold
  misc_feature (104)..(197): Pfam Name: COesterase Pfam Description: Carboxylesterase family
  misc_feature (1)..(345): Bit score of 668.2 for HMM based on sequences of Figure 2
  misc_feature (1)..(345): Functional Homolog Of SEQ ID NO. 99
MAGRNEVNLNESRRVVPLNTWVLISNFKVAYNLQRRPDGTFDRDLSEYLDRKVPANINPVDGVFSFDHVDGATGLLNRVYQPSSRIESRWGIVDLEKPLSATEVVPVIVFFHGGSFTHSSANSAIYDTFCRRLVNVCKSVVVSVDYRRSPEHRYPCAYDDGWAALKWVKSRTWLQSGKDSKVHVYLAGDSSGGNIAHNVAVRAAEAGVEVLGNILLHPMFGGQSRTESEKRLDGKYFVTLQDRDWYWRAYLPEGEDRDHPACNPFGPRGRTLDGLEFPKSLIVVAGLDLIQDWQLAYVKGLEKCGQQVKLLYLDKATIGFYFLPNNDHFYCLMNEIKGSIKSDLN

SEQ ID NO: 135 - protein, 388 aa, Vitis vinifera
  misc_feature (1)..(388): Public GI ID no. 298205013
  misc_feature (108)..(321): Pfam Name: Abhydrolase_3 Pfam Description: alpha/beta hydrolase fold
  misc_feature (104)..(147): Pfam Name: COesterase Pfam Description: Carboxylesterase family
  misc_feature (1)..(388): Bit score of 669.2 for HMM based on sequences of Figure 2
  misc_feature (1)..(388): Functional Homolog Of SEQ ID NO. 99
MAGSNEVNLSESKRVVPLNTWILISNFKLAYNLLRRPDGTFNRHLAEFLDRKVPANANPVEGVFSFDVIIDRSTSLLSRIYRPATGEEALPSIMELEKPVTGDIVPVILFFHGGSFAHSSANSAIYDTLCRRLVGICKAVVVSVNYRRAPENPYPCAYDDGWAALKWVNSRPWLKSEEDSKVHIYMVGDSSGGNIVHNVALKAVESGIEVLGNILLNPMFGGQERTESEKRLDGKYFVTIQDRDWYWRAFLPEGEDRDHAACNPFGPNGKSLVGMKFPKSLVVVAGLDLVQDWQLAYVEGLKKAGQEVKHLYLDKATIGFYLLPNNDHFYTVMDEISNFMLKMISLERLAMETNAKIGFWFKVTLLCNMSMESHCHQMSFPLFIVGQI

SEQ ID NO: 136 - protein, 345 aa, Ricinus communis
  misc_feature (1)..(345): Public GI ID no. 255567576
  misc_feature (108)..(321): Pfam Name: Abhydrolase_3 Pfam Description: alpha/beta hydrolase fold
  misc_feature (99)..(150): Pfam Name: COesterase Pfam Description: Carboxylesterase family
  misc_feature (1)..(345): Bit score of 679.5 for HMM based on sequences of Figure 2
  misc_feature (1)..(345): Functional Homolog Of SEQ ID NO. 99
MAGTNEVNLNESKRVVPLNTWVLISNFKLAYNLLRRPDGTFNRDLAEFLDRKVNANTIPVDGVFSFDHVDRATSLLNRVYLPAPENEAQWGIVELEKPLSTSEIVPVIIFFHGGSFTHSSANSAIYDTFCRRLVSTCNAVVVSVNYRRSPEYRYPCAYDDGWAALKWVKSRTWLQSGKDSKVHVYLAGDSSGGNIAHHVAVRAAEAEIEVLGNVLLHPMFGGHERTESEKRLDGKYFVTIQDRDWYWRAFLPEGEDRDHPACNIFGPRAKNLQQLKFPKSLVVVAGLDLVQDWQLAYVEGLQQAGHGVKLLYLKQATIGFYFLPNNEHFYSLMEEIRSFVNPNCL

SEQ ID NO: 137 - protein, 358 aa, Lepidium sativum
  misc_feature (1)..(358): Public GI ID no. 307752615
  misc_feature (109)..(322): Pfam Name: Abhydrolase_3 Pfam Description: alpha/beta hydrolase fold
  misc_feature (105)..(203): Pfam Name: COesterase Pfam Description: Carboxylesterase family
  misc_feature (1)..(358): Bit score of 666.5 for HMM based on sequences of Figure 2
  misc_feature (1)..(358): Functional Homolog Of SEQ ID NO. 99
MAGGNEVNLNECKRIVPLNTWVLISNFKLAYNILRRPDGSFNRDLAEFLDRKVPANAFPVDGVFSFDHVDSTTNLLTRIYQPSSLFDQTLHGTVELTRPLSTTEIIPVLIFFHGGSFTHSSANSAIYDTFCRRLVSICGVVVVSVDYRRSPEHRYPCAYDDGWNALKWVKSRIWLQSGKHSNVYVYLAGDSSGGNIAHNVAVRATKEGVQVLGNILLHPMFGGQERTESEKGLDGKYFVTIQDRDWYWRAYLPEGEDRDHPACNPFGRRGQSLKGVNFPKSLVVVAGLDLVQDWQLAYVDGLKKTGHEVNLLYLKQATIGFYFLPNNDHFHCLMEELNKFVHSIEDYERKSNPVLLTL

SEQ ID NO: 138 - protein, 358 aa, Arabidopsis lyrata
  misc_feature (1)..(358): Public GI ID no. 297817636
  misc_feature (1)..(358): Arabidopsis lyrata subsp. lyrata
  misc_feature (109)..(322): Pfam Name: Abhydrolase_3 Pfam Description: alpha/beta hydrolase fold
  misc_feature (102)..(202): Pfam Name: COesterase Pfam Description: Carboxylesterase family
  misc_feature (1)..(358): Bit score of 668.9 for HMM based on sequences of Figure 2
  misc_feature (1)..(358): Functional Homolog Of SEQ ID NO. 99
MAGGNEVNLNECKRIVPLNTWVLISNFKLAYKVLRRPDGSFNRDLAEFLDRKVPANTFPVDGVFSFDHVDSTTNLLTRIYQPASLLDLTRHGTLELTKPLSTTEIVPVLIFFHGGSFTHSSANSAIYDTFCRRLVTICGVVVVSVDYRRSPEHRYPCAYDDGWNALKWVKSRVWLQSGKDSNVYVYLAGDSSGGNIAHNVAVRATKEGVKVLGNILLHPMFGGQERTESEKSLDGKYFVTIQDRDWYWRAFLPEGEDRDHPACNPFGPRGQSLRGVNFPKSLVVVAGLDLVQDWQLAYVDGLKKNGLEVNLLYLKQATIGFYFLPNNDHFHCLMEELKKFVHPIEDSQSKSSPLLLTP

SEQ ID NO: 139 - protein, 358 aa, Arabidopsis thaliana
  misc_feature (1)..(358): Public GI ID no. 15229371
  misc_feature (109)..(322): Pfam Name: Abhydrolase_3 Pfam Description: alpha/beta hydrolase fold
  misc_feature (102)..(201): Pfam Name: COesterase Pfam Description: Carboxylesterase family
  misc_feature (1)..(358): Bit score of 668.0 for HMM based on sequences of Figure 2
  misc_feature (1)..(358): Functional Homolog Of SEQ ID NO. 99
MAGGNEVNLNECKRIVPLNTWVLISNFKLAYKVLRRPDGSFNRDLAEFLDRKVPANSFPLDGVFSFDHVDSTTNLLTRIYQPASLLHQTRHGTLELTKPLSTTEIVPVLIFFHGGSFTHSSANSAIYDTFCRRLVTICGVVVVSVDYRRSPEHRYPCAYDDGWNALNWVKSRVWLQSGKDSNVYVYLAGDSSGGNIAHNVAVRATNEGVKVLGNILLHPMFGGQERTQSEKTLDGKYFVTIQDRDWYWRAYLPEGEDRDHPACNPFGPRGQSLKGVNFPKSLVVVAGLDLVQDWQLAYVDGLKKTGLEVNLLYLKQATIGFYFLPNNDHFHCLMEELNKFVHSIEDSQSKSSPVLLTP

SEQ ID NO: 140 - protein, 345 aa, Arabidopsis thaliana
  misc_feature (1)..(345): Public GI ID no. 15229905
  misc_feature (109)..(322): Pfam Name: Abhydrolase_3 Pfam Description: alpha/beta hydrolase fold
  misc_feature (80)..(148): Pfam Name: COesterase Pfam Description: Carboxylesterase family
  misc_feature (1)..(345): Bit score of 644.6 for HMM based on sequences of Figure 2
  misc_feature (1)..(345): Functional Homolog Of SEQ ID NO. 99
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 141 - protein, 349 aa, Lepidium sativum
  misc_feature (1)..(349): Public GI ID no. 307752613
  misc_feature (109)..(322): Pfam Name: Abhydrolase_3 Pfam Description: alpha/beta hydrolase fold
  misc_feature (99)..(148): Pfam Name: COesterase Pfam Description: Carboxylesterase family
  misc_feature (1)..(349): Bit score of 636.3 for HMM based on sequences of Figure 2
  misc_feature (1)..(349): Functional Homolog Of SEQ ID NO. 99
MAASDEVNLIESRTVVPLNTWVLISNFKVAYNILRRPDGTFNRHLAEYLDRKVTANANPVDGVFSFDVLIDRRINLLSRVYRPAYGDQEQPPSVLDLEKPVDGDIVPVILFFHGGSFAHSSANSAIYDTLCRRLVGVCKCVVVSVNYRRAPENPYPCAYDDGWIALNWVNSRSWLKSKKDSKIHIFLAGDSSGGNIAHNVALKAGESGINVLGNILLNPMFGGNERTESEKLLDGRYFVTVRDRDWYWKAFLPEGEDREHPACNPFSPRGKSLEGLGFPKSLVVVAGLDLIKDWQLAYAEGLKKAGQEVKLMHLEKATVGFYLLPNNNHFHNVMDEVSAFVNAECVCKR

SEQ ID NO: 142 - protein, 343 aa, Aquilegia formosa
  misc_feature (1)..(343): Public GI ID no. 169159264
  misc_feature (1)..(343): Aquilegia formosa x Aquilegia pubescens
  misc_feature (109)..(322): Pfam Name: Abhydrolase_3 Pfam Description: alpha/beta hydrolase fold
  misc_feature (106)..(202): Pfam Name: COesterase Pfam Description: Carboxylesterase family
  misc_feature (1)..(343): Bit score of 653.3 for HMM based on sequences of Figure 2
  misc_feature (1)..(343): Functional Homolog Of SEQ ID NO. 99
MAGSNEVNINESKMAVPLNTWVLISNFKLAYTMLRRPDGTFNRNLAEFLDRKVPANANPVDGVFSFDVIIDRATGLLCRIYRQATAVPVQPSYMQLEQPLSSDVVVPVIVFFHGGSFAHSSANSAIYDTLCRRLVRNCKAVVVSVNYRRAPENRYPCAYDDGCAALKWVHSRAWLRSGKDSKAHVYLAGDSSGGNIVHNVALRAVESGAEILGNILLNPMFGGAERMESEKRLDGKYFVTLQDRDWYWRAFLPEGADRTHPACDPFGPNAASLEGVKFPKSLVVVAGLDLIHDRQLAYAQGLKKAGQDIKLMFLEQATIGFYLLPNNNHFFCLMDEINNFVSC

SEQ ID NO: 143 - protein, 343 aa, Lepidium sativum
  misc_feature (1)..(343): Public GI ID no. 307752617
  misc_feature (106)..(319): Pfam Name: Abhydrolase_3 Pfam Description: alpha/beta hydrolase fold
  misc_feature (102)..(145): Pfam Name: COesterase Pfam Description: Carboxylesterase family
  misc_feature (1)..(343): Bit score of 645.8 for HMM based on sequences of Figure 2
  misc_feature (1)..(343): Functional Homolog Of SEQ ID NO. 99
MAGSEEVNLIESKTVVPLNTWVLISNFKLAYNLLRRPDGTFNRHLAEFLDRKVPANANPVNGVFSFDVIIDRQTNLLSRVYRPALAGTPSVTDLQNPVDGEIVPVIVFFHGGSFAHSSANSAIYDTLCRRLVGLCSAVVVSVNYRRAPENRYPCAYDDGWAALNWVNSRSWLKSKKDSEVHIFLAGDSSGGNIAHNVAVRAVELGIQVLGIILLNPMFGGTERTESEEHLDGKYFVTVRDRDWYWRAFLPEGEDREHPACSPFGPRSKSLEGLSFPKSLVVVAGLDLIQDWQLKYAEGLKKAGQEVKLLYLEKATIGFYLLPNNNHFHTVMDEIAAFVNAECQ

SEQ ID NO: 144 - protein, 344 aa, Arabidopsis lyrata
  misc_feature (1)..(344): Public GI ID no. 297812999
  misc_feature (1)..(344): Arabidopsis lyrata subsp. lyrata
  misc_feature (107)..(320): Pfam Name: Abhydrolase_3 Pfam Description: alpha/beta hydrolase fold
  misc_feature (103)..(146): Pfam Name: COesterase Pfam Description: Carboxylesterase family
  misc_feature (1)..(344): Bit score of 650.3 for HMM based on sequences of Figure 2
  misc_feature (1)..(344): Functional Homolog Of SEQ ID NO. 99
MAGSEEVNLIESKTVVPLNTWVLISNFKLAYNLLRRPDGTFNRHLAEFLDRKVPANANPVNGVFSFDVIIDRQTNLLSRVYRPANAGPPPSVTDLQNPVDGEIVPVIVFFHGGSFAHSSANSAIYDTLCRRLVGLCGAVVVSVNYRRAPENRYPCAYDDGWAVLNWVNSSSWLKSKKDSKVHIFLVGDSSGGNIVHNVALRAVESGINVLGNILLNPMFGGTERTESEKRLDGKYFVTVRDRDWYWRAFLPEGEDREHPACSPFGPRSKSLEGLSFPKSLVVVAGLDLIQDWQLKYAEGLKKAGQDVKLLYLEQATIGFYLLPNNNHFHTVMDEIAAFVNAECQ

SEQ ID NO: 145 - protein, 346 aa, Cucurbita maxima
  misc_feature (1)..(346): Public GI ID no. 238654633
  misc_feature (111)..(323): Pfam Name: Abhydrolase_3 Pfam Description: alpha/beta hydrolase fold
  misc_feature (107)..(150): Pfam Name: COesterase Pfam Description: Carboxylesterase family
  misc_feature (1)..(346): Bit score of 647.4 for HMM based on sequences of Figure 2
  misc_feature (1)..(346): Functional Homolog Of SEQ ID NO. 99
MMAGSNRINLNDSMMVVPLNTWVLISNFKLAYNLLRRPDGTFNRHLAEFLDRKVPANANPVDGTFSFDVIIDRATGLLCRIYRPTIGDEPQSTYIVDLEKPVDSEVVAPVIIFFHGGSFAHSSANSAIYDTLCRRLVSICKAVVVSVNYRRAPENRYPCAYDDGWTALNWVKSKSWLRSKDSKTYIYLAGDSSGGNIVHHVASRTVKSGIEVFGNILLNPMFGGQERTKSEVRLDGKYFVTIRDRDWYWRAFLPEGEDRDHPACNPFGPRGNSLEKIKFPKSLVVVAGFDLVKDWQLAYAKGLEKDGQKVKLLYLDQATVGFYLLPNTEHFYTVMDEISEFVSSDC

SEQ ID NO: 146 - protein, 344 aa, Galega orientalis
  misc_feature (1)..(344): Public GI ID no. 308220216
  misc_feature (108)..(321): Pfam Name: Abhydrolase_3 Pfam Description: alpha/beta hydrolase fold
  misc_feature (104)..(149): Pfam Name: COesterase Pfam Description: Carboxylesterase family
  misc_feature (1)..(344): Bit score of 656.9 for HMM based on sequences of Figure 2
  misc_feature (1)..(344): Functional Homolog Of SEQ ID NO. 99
MTGSNEVNLSESKSVVPLNTWVLISNFKLAYNLLRRADGTFNRELAEFLDRKVPANTIPVDGVFSFDHVDRNTGLFSRVYQPASENVTTWGIIELEKPLSTTEIVPVIIFFHGGSFSHSSANSAIYDTFCRRLVSMCKAVVVSVNYRRSPEHRYPCAYEDGWNALQWVKSRTWLQSGKDSKVYVYMAGDSSGGNIAHHVAVRAAEEDVEVLGNILLHPLFGGERRTESEKKLDGKYFVRLQDRDWYWRAFLPEGEDRDHPACNPFGPKGKSLAGLKFAKSLVCVAGLDLLQDWQLEYVEGLKSFDQDVKLLYLKEATIGFYFLPNNDHFYCLFNEINTFVHPNC

SEQ ID NO: 147 - DNA, 1026 bp, Populus trichocarpa
  misc_feature (1)..(1026): Ceres Annot ID no. 1444948
  misc_feature (1)..(1026): Encodes the peptide sequence at SEQ ID NO. 148
atgactggcttggctctcaatcaatccaagagggttgttccgctaaacacatgggtcctcatttccaatttcaagcttgcatataatctccttcgccgcccggatgggacctttaaccgcgaattggcagagttccttgaacgaaaggtccaggccaacaccatcccagttgatggggttttctcctttgatcatgttgacagaaccacgggcctccttaaccgggtttaccaacctgcccctgaaagtgaggcgcaatggggcattgtagaacttgaaaagcccttgaacactacggaggttgttccagtcataatcttcttccacggtggaagctttactcattcctctgctaatagtgctatttatgacaccttttgtcgccgccttgtcagcgcttgcaaggctgttgtggtgtctgttaattatcgtcgatcacctgagtatcgatacccttgcgcgtatgatgatggctggacggctcttaagtgggttaaatctagaacttggcttcaaagtggaaaggattctaaggttcatgtctatttggctggcgatagttcaggtggtaatatagctcaccatgttgccgcgagagcggcggaggaagaaatcgatgtgttgggtaatattcttcttcacccaatgtttggtggtcaacagagaacagaatcagagaagatattagatggcaagtactttgttacaattcaagaccgcgactggtattggagagcatatctacctgaaggagaagatagggaccatccagcatgtaatatatttggtccaagggggaaaaagcttgaaggactggagttccctaaaagtctagttgttgtggctggtttcgatctcgttcaagactggcaattggcatatgttgaaggactccagagagctggccatgaagtgaaacttctctatctaaaacaggccacaatagggttctacttcctgccaaataatgatcacttctattgtctcatggaggagataaaaaagtttgtgaattctaactgttaa

SEQ ID NO: 148 - protein, 341 aa, Populus trichocarpa
  misc_feature (1)..(341): Ceres Annot ID no. 1444948
  misc_feature (105)..(318): Pfam Name: Abhydrolase_3 Pfam Description: alpha/beta hydrolase fold
  misc_feature (86)..(146): Pfam Name: COesterase Pfam Description: Carboxylesterase family
  misc_feature (1)..(341): Bit score of 669.7 for HMM based on sequences of Figure 2
  misc_feature (1)..(341): Functional Homolog Of SEQ ID NO. 99
MTGLALNQSKRVVPLNTWVLISNFKLAYNLLRRPDGTFNRELAEFLERKVQANTIPVDGVFSFDHVDRTTGLLNRVYQPAPESEAQWGIVELEKPLNTTEVVPVIIFFHGGSFTHSSANSAIYDTFCRRLVSACKAVVVSVNYRRSPEYRYPCAYDDGWTALKWVKSRTWLQSGKDSKVHVYLAGDSSGGNIAHHVAARAAEEEIDVLGNILLHPMFGGQQRTESEKILDGKYFVTIQDRDWYWRAYLPEGEDRDHPACNIFGPRGKKLEGLEFPKSLVVVAGFDLVQDWQLAYVEGLQRAGHEVKLLYLKQATIGFYFLPNNDHFYCLMEEIKKFVNSNC

SEQ ID NO: 149 - DNA, 1480 bp, Glycine max
  misc_feature (1)..(1480): Ceres Clone ID no. 1172108
  misc_feature (1)..(1480): Encodes the peptide sequence at SEQ ID NO. 150
ctccgtccattcccgtcgttcttttgcgtttgactctctctttctctttctttgttcttcactttcttatcctctcatatccgtgatctctctctgttcccttcttctgtctcatgcacacaccactgtaccttgttctcaccgaaaccttcaactaggaatcgatcgagagtgtcttgtgttgctagtgcaagaggctgcaatatagatagatacgttcgtgcgtacgtaggaagggtacgtacgcggtagtacacaagacacgacgccgttttgcactctgttcttatttccgatcatgagggcgcacaagaagggtgttaccgtggggatcactgttgctgcttcttaagcctttttcttttcttatgtgggttccccccttcccctttcgattttctgcactttagagagacaaccagacatggctggcagtaaccaggtcaatctcaatgaatctaggagtgttgttccgttaaatacatgggtgcttatttccaatttcaagctgtcttacaagcttctcagacgtgacgatggaacgttcaatcgtgagttggcggagtttctggataggaaggtccccgcgaacgcaattcctgttgaaggggtgttttcaatcgattatgttgatagaaacgcgggtttgttttaccgtgtgtacttgccagcctctggaaacgaggctcaatggggtatcaaagaccttgagaagccgttgagtactacagaaattgttcctgtgattatattcttccacgggggaagcttttcgcattcctcggccaacagtgccatctacgacaccttctgccggcgccttgtgaggatttgcagggctgctgtggtgtctgtgaactaccggcgatcaccggagcaccggtatccttgcgcctacgacgacggctgggcggcactgaggtgggtgaagtcgagagcatggctgcaaagtgggagggagtccaaggttcatgtctacttggcaggggacagttctggagggaacattgttcatcatgtggcagtgatggctgcagaggaggaaattgaggtcctggggaatattcttctccaccctttgtttggtggggagaagagaacggaatcagagttgagattggatgggaaatactttgtgaggctgaaggatcgtgattggtattggagggcttttctacctgaaggagagaatagagaccaccctgcttgcaacccttttggaccaagggggagaagcattgcaggactcaaattccccaaaagtttagtttgtgtggctggtttggatcttctgcaggattggcaattggcatatgcaaaaggtcttcaggattctggacaacaggtcaagcttctttttctcaaggaagccactattggcttttacttcctaccaaacaatgaccatttctattgcctcatgacagaaatcaacaactttgtcaattctgattctgactgttaatatactattagtact

SEQ ID NO: 150 - protein, 346 aa, Glycine max
  misc_feature (1)..(346): Ceres Clone ID no. 1172108
  misc_feature (108)..(321): Pfam Name: Abhydrolase_3 Pfam Description: alpha/beta hydrolase fold
  misc_feature (104)..(202): Pfam Name: COesterase Pfam Description: Carboxylesterase family
  misc_feature (1)..(346): Bit score of 642.0 for HMM based on sequences of Figure 2
  misc_feature (1)..(346): Functional Homolog Of SEQ ID NO. 99
MAGSNQVNLNESRSVVPLNTWVLISNFKLSYKLLRRDDGTFNRELAEFLDRKVPANAIPVEGVFSIDYVDRNAGLFYRVYLPASGNEAQWGIKDLEKPLSTTEIVPVIIFFHGGSFSHSSANSAIYDTFCRRLVRICRAAVVSVNYRRSPEHRYPCAYDDGWAALRWVKSRAWLQSGRESKVHVYLAGDSSGGNIVHHVAVMAAEEEIEVLGNILLHPLFGGEKRTESELRLDGKYFVRLKDRDWYWRAFLPEGENRDHPACNPFGPRGRSIAGLKFPKSLVCVAGLDLLQDWQLAYAKGLQDSGQQVKLLFLKEATIGFYFLPNNDHFYCLMTEINNFVNSDSDC

SEQ ID NO: 151 - protein, 345 aa, Medicago truncatula
  misc_feature (1)..(345): Public GI ID no. 169159250
  misc_feature (108)..(321): Pfam Name: Abhydrolase_3 Pfam Description: alpha/beta hydrolase fold
  misc_feature (90)..(147): Pfam Name: COesterase Pfam Description: Carboxylesterase family
  misc_feature (1)..(345): Bit score of 646.8 for HMM based on sequences of Figure 2
  misc_feature (1)..(345): Functional Homolog Of SEQ ID NO. 99
MAGSNQLNPNDSKMVVPLNMWVLISNFKLAYNLLRRPDGTFNRDLAEFLDRKVPANANPVDGVFSFDVIVDRETNLLTRIYRPVEGEEQHVNIVDLEKPATAEVLPVVMFFHGGSFAHSSANSAIYDTLCRRLVGICNAVVVSVNYRRAPENRYPCAYEDGWKAVKWVNSRTWLQSKKDSKVHIYMVGDSSGGNIVHHVALKALDSGIPVLGNILLNPLFGGEERTESEKRLDGRYFVRVKDRDWYWRAFLPEGEDRDHHACNPFGPKGRSLEGVAFPKSLVVVAGLDLVQDWQLGYAKGLEKAGQNVKLLFLEQATVGFYLLPNNEHFSVVMDEIKHFVNSDCS

SEQ ID NO: 152 - protein, 345 aa, Solanum lycopersicum
  misc_feature (1)..(345): Public GI ID no. 169159262
  misc_feature (108)..(321): Pfam Name: Abhydrolase_3 Pfam Description: alpha/beta hydrolase fold
  misc_feature (102)..(197): Pfam Name: COesterase Pfam Description: Carboxylesterase family
  misc_feature (1)..(345): Bit score of 658.7 for HMM based on sequences of Figure 2
  misc_feature (1)..(345): Functional Homolog Of SEQ ID NO. 99
MVDTKEINTNESKRVVPLNTWILISNFKLAYNMLRRSDGTFNRDLAEFLERKVGANSIPVDGVYSFDVVDRCTSLLNRVYKPAPKNECDWGKIDLDTPLSTSEIVPVIIFFHGGSFTHSSANSAIYDTFCRRLVSICKAVVVSVNYRRSPENRYPCAYDDGWAALQWVKSRAWLQSGEDLKVHVYMSGDSSGGNIAHHVAVQAAESGVEVLGNILLHPMFGGQNRTESESRLDGKYFVTVQDRDWYWRAYLPVGEDRDHPACNIFGPRGKTLQGLKFPKSLVVVAGLDLVQDWQLNYVEGLKKSGHEVNLLYLKQATIGFYFLPNNDHFRCLMEEINKFIHPNHS

SEQ ID NO: 153 - DNA, 1917 bp, Gossypium hirsutum
  misc_feature (1)..(1917): Ceres Clone ID no. 1924067
  misc_feature (1)..(1917): Encodes the peptide sequence at SEQ ID NO. 154
atttttcccgtctttttcttctattttcttggtggtttcgtgcttcagaaaggaagtgtctcttcttgtttagaaaaaaaaaacccccaagaacgaggaatcaatcaaaaagagaagaaaggtgtcacggtcgtaacgaatgcacatgtgcttagttttcttgaggcttttattcgctctttgcttctcccctttgaatctgcttctacttttagaaaatttcctgaattctcatcttctagccccgtcacagactaatacaaagaaaagacacccaagagcagaaaaggagggacaatacacctatgcggtcttgctttagtttcttgctactatgaggctgtctttgtgaagattggttttgtttcctcggtgggttctttttcttgcatctttttttcccttttttgttttccgtcttgggggtgttctgagtctggtttgtttgagccatggctggtagcaatgaagtcaacctcaatgaatccaagagggttgtaccgttgaatacctgggtcctcatttctaatttcaagctatcgtacaatctacagcgccgtccagatggaaccttcaacagagacttatcggagttccttgaccgtcgagtacctgccaatatcaacccggtcgatggggtcttctccttcgatcatgtcgacggagccaccggccttcttaaccgggtttatcagccatctcccaaaaacgaggctcagtggggcatcgtcgacctcgagaaacctttgagcacaaccgagatcgttccggtcatagtcttcttccacggcgggagtttcactcattcctccgcaaacagcgccatctacgacaccttttgtcgtcgcctcgtcaacatttgcaaagccgtcgttgtgtcagtgaactatcgccgatcgcccgaacaccgatacccttgtgcgtacgacgatggttgggcggctctaaagtgggttaaatcaagaacttggcttcaaagtggaaaggactccaaagtgcacgtgtacttggctggcgatagttctggtggcaacatagctcaccatgttgcggtgagagcagcagaggctgacgttgaggtactaggcaacattctccttcacccaatgttcggtgggcagatgagaacggaatccgaaaagagattggacggcaagtacttcgtgacgctccacgaccgcgattggtattggcgagcttatctaccggaaggcgaagatcgagaccatccggcttgtaacccgttcgggccaagaggtcgaacccttgaaggtctcaagttcccgaaaagtctggtagtcgtggcgggtttggatctgattcaagactggcaattggcatacgttgaaggacttaaaaaatcgggtcaagaggtgaaactccttttcttagagaaagccacttggcttctatttcttgcctaacaacgatcacttctactgcctcatggaggagatgaacaacttcgttcattccaactgttaataccactcaccctgcgtagttataacctctacttaaccatacgtaacaaaagttcctttccccctttaaatgtttttttatcaatggtgtgtagttataagcttgttttgtgttcttacttgattactacgtttcgttttttgcggtggcggtggccgatgagcaccaaccagatacaaggaaaagggcctttctctagttagcttcctgcctcaaataacgggaagagagaagtgttgggggggggtaatgctggggtggcttattgtgttaattggtaaattcttaaaagcactaatttcagaacaaggaatggaatttcatttttcttttttatatatgtgtatgtgttgtcttgtaatgaagttgtatgttgatgttatacttgtactatgtgttctaaaggtaatatataaaagattttgttctgtc

SEQ ID NO: 154 - protein, 323 aa, Gossypium hirsutum
  misc_feature (1)..(323): Ceres Clone ID no. 1924067
  misc_feature (108)..(315): Pfam Name: Abhydrolase_3 Pfam Description: alpha/beta hydrolase fold
  misc_feature (80)..(198): Pfam Name: COesterase Pfam Description: Carboxylesterase family
  misc_feature (1)..(323): Bit score of 641.4 for HMM based on sequences of Figure 2
  misc_feature (1)..(323): Functional Homolog Of SEQ ID NO. 99
MAGSNEVNLNESKRVVPLNTWVLISNFKLSYNLQRRPDGTFNRDLSEFLDRRVPANINPVDGVFSFDHVDGATGLLNRVYQPSPKNEAQWGIVDLEKPLSTTEIVPVIVFFHGGSFTHSSANSAIYDTFCRRLVNICKAVVVSVNYRRSPEHRYPCAYDDGWAALKWVKSRTWLQSGKDSKVHVYLAGDSSGGNIAHHVAVRAAEADVEVLGNILLHPMFGGQMRTESEKRLDGKYFVTLHDRDWYWRAYLPEGEDRDHPACNPFGPRGRTLEGLKFPKSLVVVAGLDLIQDWQLAYVEGLKKSGQEVKLLFLEKATWLLFLA

SEQ ID NO: 155 - protein, 350 aa, Medicago truncatula
  misc_feature (1)..(350): Public GI ID no. 169159252
  misc_feature (109)..(327): Pfam Name: Abhydrolase_3 Pfam Description: alpha/beta hydrolase fold
  misc_feature (105)..(149): Pfam Name: COesterase Pfam Description: Carboxylesterase family
  misc_feature (1)..(350): Bit score of 623.1 for HMM based on sequences of Figure 2
  misc_feature (1)..(350): Functional Homolog Of SEQ ID NO. 99
MTGTNEVNLSESRSVVPLNTYVLISNFKLAYNLLRRADGTFNRDLAEFLDRKVPANAIPVDGVFSFDHIERNTGLFNRVYLPSSSENESQWGVKDLEKPLSTTEIVPVIVFFHGGSFSHSSANSAIYDTFCRRLVSVCKAAVVSVNYRRSPEYRFPCAYEDGWNALKWVKSRKWLQSGKEKKVYVYMAGDSSGGNIVHHVAVKACEEKAEGIEVLGNILLHPLFGGEKRTDSEMRLDGKYFVRLQDRDWYWRAFLPEGEDRDHPACNPFGPKGEKNLKGLDKFPKSLVCVAGLDLLQDWQLAYVDGLRNFGQDVKLLYLKEATIGFYFLPNNDHFYCLREEIKNFVNPNC

SEQ ID NO: 156 - protein, 352 aa, Picea sitchensis
  misc_feature (1)..(352): Public GI ID no. 116794075
  misc_feature (100)..(316): Pfam Name: Abhydrolase_3 Pfam Description: alpha/beta hydrolase fold
  misc_feature (81)..(139): Pfam Name: COesterase Pfam Description: Carboxylesterase family
  misc_feature (1)..(352): Bit score of 550.7 for HMM based on sequences of Figure 2
  misc_feature (1)..(352): Functional Homolog Of SEQ ID NO. 99
MASSDDYGFNEAKMVVPLNTFVLISNFKLVYNLLRRPDGTFNRHLAEFLERKAPANATPVSGVFSLDVVMDRDSGLWSRIYTPIAATSDSTANVAGLPVIIFFHGGSFVHSSANSAIYDVLCRHLSSFCSAIVISVNYRRAPEHIYPAPYEDGWAALRWVTSPVARQWLRHEVDTERQLFLAGDSSGGNIVHHVARRAADTGIPVAGNILLNPMFGGEKRTESERRLDGKYFVTIRDRDWYWNAFLPEGANRDHPACNPFGPHGPKLDGIRFPKSLVVVAGLDLLQDWQRNYAEELRRAGKDVKLMFLDQATVGFYLLPNTDLFFYVMGEIKRFVNGDGNSEEEIGAGNSVN

SEQ ID NO: 157 - protein, 357 aa, Pinus taeda
  misc_feature (1)..(357): Public GI ID no. 169159248
  misc_feature (100)..(316): Pfam Name: Abhydrolase_3 Pfam Description: alpha/beta hydrolase fold
  misc_feature (80)..(139): Pfam Name: COesterase Pfam Description: Carboxylesterase family
  misc_feature (1)..(357): Bit score of 546.0 for HMM based on sequences of Figure 2
  misc_feature (1)..(357): Functional Homolog Of SEQ ID NO. 99
MASSDDYGFNEAKMVVPLNTFVLISNFKLVYNLLRRPDGTFNRHLAEFLDRKAPANATAVSGVFSLDVVMDRDSGLWSRIYTPVGATSDSAANAAGLPVIIFFHGGSFAHSSANSAIYDVLCRHFSSFCSAIVVSVNYRRAPEHIYPAPYEDGWTALRWVTSPAARPWLRHEVDTERQLFLAGDSSGGNIVHHVARRAGETGIHVAGNILLNPMFGGEQRTESERRLDGKYFVTIRDRDWYWNAFLPAGANRDHPACNPFGPHGPRLEEIRFPQSLVVVAGLDLLQDWQRNYAEELRRAGKEVKLMFLEQTTIGFYLLPNTDLFFNVMGEIKRFVNGNGNGNGNTEEEGNGAENSVN

SEQ ID NO: 158 - protein, 352 aa, Picea glauca
  misc_feature (1)..(352): Public GI ID no. 169159246
  misc_feature (100)..(316): Pfam Name: Abhydrolase_3 Pfam Description: alpha/beta hydrolase fold
  misc_feature (81)..(139): Pfam Name: COesterase Pfam Description: Carboxylesterase family
  misc_feature (1)..(352): Bit score of 546.8 for HMM based on sequences of Figure 2
  misc_feature (1)..(352): Functional Homolog Of SEQ ID NO. 99
MASSDDYGFNEAKMVVPLNTFVLISNFKLVYNLLRRPDGTFNRHLAEFLERKAPANATPVSVVFSLDVVMDRDSGLWSRIYTPIAATSDSTANVAGLPVIIFFHGGSFVHSSANSAIYDVLCRHLSSFCSAIVISVNYRRAPEHIYPAPYEDGWAALRWVTSPVARQWLRHEVDTERQLFLAGDSSGGNIVHHVARRAADTGIPVAGNILLNPMFGGEKRTESERRLDGKYFVTIRDRDWYWNAFLPEGANRDHPACNPFGPHGPKLDGIRFPKSLVVVAGLDLLQDWQRNYAEELRRAGKDVKLMFLDQATVGFYLLPNTDLFFYVMGEIKRFVNGDGNSEEEIGAGNSVN

SEQ ID NO: 159 - protein, 308 aa, Rosa lucieae
  misc_feature (1)..(308): Public GI ID no. 256772632
  misc_feature (118)..(307): Pfam Name: Abhydrolase_3 Pfam Description: alpha/beta hydrolase fold
  misc_feature (114)..(159): Pfam Name: COesterase Pfam Description: Carboxylesterase family
  misc_feature (1)..(308): Bit score of 554.2 for HMM based on sequences of Figure 2
  misc_feature (1)..(308): Functional Homolog Of SEQ ID NO. 99
MLILFHWEYEMNMCVSGILCSLQMVVPLNTWVLISNFKLSYNLLRRPDGTFNRHLAEFLDRKVAPNANPVDGVLSFDVIIDKGTSLLTRIYQPASADAPQPNILDFHKPVGVEVLPVIIFFHGGSFAHSSANSGIYDILCRRLVGNCKAVVVSVNYRRAPENRFPCAYDDGWTALKWVNSRSWLKSTKDSKVHIYLAGDSSGGNIVHNVALRAAESGIEVLGNILLNPMFGGLERTESEERLDGKYFVTIQDRDWYWRAFLPEGEDRDHPACNPFGPRGISLKDVKFPKSLVVVAGLDLVQDWQLAYV

SEQ ID NO: 160 - protein, 359 aa, Selaginella moellendorffii
  misc_feature (1)..(359): Public GI ID no. 302794147
  misc_feature (102)..(329): Pfam Name: Abhydrolase_3 Pfam Description: alpha/beta hydrolase fold
  misc_feature (93)..(200): Pfam Name: COesterase Pfam Description: Carboxylesterase family
  misc_feature (1)..(359): Bit score of 426.7 for HMM based on sequences of Figure 2
  misc_feature (1)..(359): Functional Homolog Of SEQ ID NO. 99
MNSCSKAILKPSKDVVPLSTWILISKLKVEYMLTRGADGSFNRNLAEFHDRKASASLAPHDGVASMDVTIDRSSGLWSRIFLPAIAYAQEEQANRDDKVPIIFYFHGGSYAHSSANTALYDMVCRQLCRTCRAVVISVNYRRAPEHRCPAAYRDGLAALRWLRLQAARHVAATWLPPGADLSRCFLAGDSSGGNMVHHVGVAAATARHELWPVRVVGHVLLMPMFGGVERTASERRLDGQYFVTVKDRDYYWKLFLPEGADRDHPACNVFGPGSDAERVLGEIPVPKSLVVVAGLDLTQDWQLRYARGMERSGKSVEVLVLEDTPVGFFIFPNTEQYYRVMDKIRGFVRDEQEPMDSST

SEQ ID NO: 161 - protein, 280 aa, Vitis vinifera
  misc_feature (1)..(280): Public GI ID no. 296086662
  misc_feature (92)..(173): Pfam Name: Abhydrolase_3 Pfam Description: alpha/beta hydrolase fold
  misc_feature (89)..(130): Pfam Name: COesterase Pfam Description: Carboxylesterase family
  misc_feature (1)..(280): Bit score of 199.9 for HMM based on sequences of Figure 2
  misc_feature (1)..(280): Functional Homolog Of SEQ ID NO. 99
MAGSDEVNHNESKRVVPLNTWILISNFKLAYNLLRRPDGTFERELAEFLERKAPANSFPVDGVFSFDIVDKTTGLLNRVYQPAPENEAHAIYDYFCRRLVGNCKAVVVSVNYRRSPEHRYPCAYDDGWAALKWVKSRSWLQSGKDSKVHVYLAGDSSGGNITHHVAVRAAESGIEVLDRDWYWRAFLPEGEDRDHPACNPFGPRGKSLEGLNFPKSLVVVAGFDLVQDWQLAYVEGLKKAGQDVNLLFLEQATIGFYFLPNNDHFYCLMEEIKNFVKSNC

SEQ ID NO: 162 - protein, 371 aa, Selaginella moellendorffii
  misc_feature (1)..(371): Public GI ID no. 302782397
  misc_feature (109)..(332): Pfam Name: Abhydrolase_3 Pfam Description: alpha/beta hydrolase fold
  misc_feature (97)..(148): Pfam Name: COesterase Pfam Description: Carboxylesterase family
  misc_feature (1)..(371): Bit score of 438.8 for HMM based on sequences of Figure 2
  misc_feature (1)..(371): Functional Homolog Of SEQ ID NO. 99
MEPEEDSSAEELQLKESKEVVPLNTWVLISNLKLAYNLTRNSDGSFNRNLDEFLDRKVPVSSVEREDDPVTFMDVTIDRTSGIWSRIFIPRASHNNNASSTTHGTPIFFYFHGGSFVHMSANSAVYHTVCQQLARLCQAVVISVNYRRAPEHKYPAAYNDCYAALTWLKVQVLRGVAHAWLPRTADLGRCFLVGDSNGGNIVHHVGVRAAESGAELGPLRVAGHILIIPMFGGNRRTQSELRFDGQYFVTIKDRDFYWQSFLPAGADRDHPACNIFGPSSRSLEGVVLPPSLVAVAGLDMIKDWQLQYVEGMRNAGKDVELLFLEEATVGFFIFPNTGHFHRLMDKITAFIDRDGDQHLTRRTGITRRTTT

SEQ ID NO: 163 - protein, 371 aa, Selaginella moellendorffii
  misc_feature (1)..(371): Public GI ID no. 302787771
  misc_feature (102)..(329): Pfam Name: Abhydrolase_3 Pfam Description: alpha/beta hydrolase fold
  misc_feature (93)..(200): Pfam Name: COesterase Pfam Description: Carboxylesterase family
  misc_feature (1)..(371): Bit score of 425.5 for HMM based on sequences of Figure 2
  misc_feature (1)..(371): Functional Homolog Of SEQ ID NO. 99
MNSCSKAILKPSKDVVPLSTWILISKLKVEYMLTRGADGSFNRNLAEFHDRKASASLAPHDGVASMDVTIDRSSGLWSRIFLPAIAYAQEEQENRDDKVPIIFYFHGGSYAHSSANTALYDMVCRQLCRTCRAVVISVNYRRAPEHRCPAAYRDGLAALRWLRLQAARHVAATWLPPGADLSRCFLAGDSSGGNMVHHVGVAAATARHELWPVRVVGHVLLMPMFGGVERTASERRLDGQYFVTVKDRDYYWKLFLPEGADRDHPACNVFGPGSAAERVLGEIPVPKSLVVVAGLDLTQDWQLRYARGMERSGKSVEVLVLEDTPVGFFIFPNTEQYYRVMDKIRGFVRDEEEPMDSSTWRDSSLARQERE

SEQ ID NO: 164 - protein, 367 aa, Selaginella kraussiana
  misc_feature (1)..(367): Public GI ID no. 156446298
  misc_feature (108)..(330): Pfam Name: Abhydrolase_3 Pfam Description: alpha/beta hydrolase fold
  misc_feature (103)..(148): Pfam Name: COesterase Pfam Description: Carboxylesterase family
  misc_feature (1)..(367): Bit score of 417.7 for HMM based on sequences of Figure 2
  misc_feature (1)..(367): Functional Homolog Of SEQ ID NO. 99
MNVEAETERVQLKESKEVVPLSTWVLISNLKVAYTLARQPDGSFNRELAEFLDRKVAPCNVDGVVSMDVVMDRSTGLWSRIFIPTGGANHGNVGGGNGDGAATMPIFFYFHGGSFAHSSANSALYNTVCTHVARHCQVVVISVNYRRSPEHRYPAAYDDCATAVHWLAAQINSGNHTTWLPPTADPSRCFLAGDSNGGNIAHHVAVRWARDRTAGISPATSSLNIVGTILLIPMFGGTRRTPSELRYDGQYFVTIRDRDYYWQSFLPLGADRDHPACNIFGPNSPRLDELPLPPMLLAVAELDMILDWQMEYLSGMRRAGKTIHKLFLREATVGFFIFPNTLHFHLLMDAIKKFIRDPGAASIGEEA

SEQ ID NO: 165 - DNA, 1066 bp, Gossypium hirsutum
  misc_feature (1)..(1066): Ceres Clone ID no. 1843446
  misc_feature (1)..(1066): Encodes the peptide sequence at SEQ ID NO. 166
gcgtcctctctctctgttattttcctctctttctctcttccatttctctctctctatttagtggtgttgggttcttctgttcttcagaaaggaagcgtctcttcttgttcagaacaaaaaagaaaagccaaagaaaagagggagagtatagagactcaagtacaaaagagcaaaaaaaaaaaaaacccaagaaaccaaataaataaaaggaagggtgggggcaaatagacaacgtacaaacactcttactttttagtgttttttttctttctttcttgttgttatgaggtttcctttgggaagataagtttcatttcctttcttgggggttttctttaaaaccttttgtttttgcttttccttcttggagttcttttccagtctggtttgttcggccatggccggtagcaatgaagtcaacctcaatgaatccaagagggttgttccattgaatacatgggtcctcatttccaatttcaagctagcttacaatctacaacgccgtcctgatggaaccttcaaccgagatttatctgagttccttgaccgtagagtccctgccaatataaaccctgtcgatggggttttctccttcgaccatgtcgacggtgccaccggtcttctaaaccgggtttatcagccttcttcgttgaatgaggctcaatggggcatggtagaccttgagaaacctttgagcacaactgagattgttcctgtcatagtgttcttccacggtggaagcttcactcattcctccgctaatagtgctatctatgacaccttttgtagacgcctcgttagcctttgtaaggccgttgtggtgtctgtaaattatcgccgatcgcctgaacatagatacccttgcgcgtacgatgatggttgggcggctcttaagtgggttaaatcaagaacttggcttcaaagtgggaaggattctaatgtccatgtctacttggctggtgatagttctggtggaaatatagctcaccatgtagccgtgagagcggccgaagctgatgtcgaggtattaggtgacattcttcttcatccgatgtttggtgggcgg

SEQ ID NO: 166 - protein, 223 aa, Gossypium hirsutum
  misc_feature (1)..(223): Ceres Clone ID no. 1843446
  misc_feature (108)..(219): Pfam Name: Abhydrolase_3 Pfam Description: alpha/beta hydrolase fold
  misc_feature (98)..(199): Pfam Name: COesterase Pfam Description: Carboxylesterase family
  misc_feature (1)..(223): Bit score of 428.0 for HMM based on sequences of Figure 2
  misc_feature (1)..(223): Functional Homolog Of SEQ ID NO. 99
MAGSNEVNLNESKRVVPLNTWVLISNFKLAYNLQRRPDGTFNRDLSEFLDRRVPANINPVDGVFSFDHVDGATGLLNRVYQPSSLNEAQWGMVDLEKPLSTTEIVPVIVFFHGGSFTHSSANSAIYDTFCRRLVSLCKAVVVSVNYRRSPEHRYPCAYDDGWAALKWVKSRTWLQSGKDSNVHVYLAGDSSGGNIAHHVAVRAAEADVEVLGDILLHPMFGGR

SEQ ID NO: 167 - protein, 336 aa, Physcomitrella patens
  misc_feature (1)..(336): Public GI ID no. 168008743
  misc_feature (1)..(336): Physcomitrella patens subsp. patens
  misc_feature (96)..(314): Pfam Name: Abhydrolase_3 Pfam Description: alpha/beta hydrolase fold
  misc_feature (91)..(138): Pfam Name: COesterase Pfam Description: Carboxylesterase family
  misc_feature (1)..(336): Bit score of 307.9 for HMM based on sequences of Figure 2
  misc_feature (1)..(336): Functional Homolog Of SEQ ID NO. 99
MASLVQLRILSEFVVRANRVTRRRDGTINRWLADTLEKKVPANPIPVKGVSSADVTIDAEAGIWARVFSLTEEIEETSLPTATDGNQRLFKTMPIILYYHGGGFAVLCPNFYLYDIFCRRLARKCNAIVISVHYRRAPEFKFPTAYDDSYKAMEWLQSKEATVSLPPNVDFSRVFLSGDSAGGNIAHHVALRAAGKDLGRLSLKGLVLIQPFFGGEERTSAELRLKNVPIVSVESLDWHWKAYLPEGANRDHPSCNIFGPNSPDLSDVPLPPILNIVGGLDILQDWEMRYSEGMKKAGKEVQTIFYEEGIHTFALLNQAKLASQMLLDVAAFINSH

SEQ ID NO: 168 - DNA, 1026 bp, Populus trichocarpa
  misc_feature (1)..(1026): Ceres Annot ID no. 1449351
  misc_feature (1)..(1026): Encodes the peptide sequence at SEQ ID NO. 169
atgagcagtgaaacaccagaaccggcaaaactagccatcccatggaggacacgactggtccttacaatgatctcagcggcaacagatctgtcacgtcgttcaaacggcaccataaacagacgtttgcttaatctccttgacttcaagtcctctccttcccctaacaaacccattcactccatcatctcttctgatatcaccgtggaccccacccgcaacctctggttccgcctctacaccccggaaaatagcggggttgacggtagcgatactccctctttgcctgttgtggtattttttcatggaggtggattttctttcctaagtgccgcatcaagttcgtacgacgtcgtttgtcgcaggtttgcacgtatatttcctgctattgttctttcagttaattaccgtcttacgcctgaacatcgatttccctgtcaatacgatgatggttttgaagtgcttcggttcctggacaatgatcgagccaatgggttactgccacctaatgcagacttgtctaagtgttttctggtcggagatagtgccggggcaaatttggcccatcatgttgcggttcgggcttgtcgggctgggtttcagaatgttaaggtaattggattggtttctattcagccgtattttggcgggcaagagaggaccgagtcggaactccaactggttggatacccgttcgtgacggtggaacgaaccgattggtgctggagagtgtttttgccggatggatcggatcgggatcactatgcagtgaatgtgagtggaccgaatgctgagaacatctcggatttggattttccggatacaattgtgattgttggtgggttcgacccgttacaagattggcaaaggaggtattatgagtggttaaagagatccgggaaagaggctaccttaattgagtattcaaatatgtttcacgcattttatatcttcccggagctgcccgagtcttcaagattattctcggagatcaaagaatttgttaccaagagactgtctaagccatag

SEQ ID NO: 169 - protein, 341 aa, Populus trichocarpa
  misc_feature (1)..(341): Ceres Annot ID no. 1449351
  misc_feature (97)..(315): Pfam Name: Abhydrolase_3 Pfam Description: alpha/beta hydrolase fold
  misc_feature (88)..(138): Pfam Name: COesterase Pfam Description: Carboxylesterase family
  misc_feature (1)..(341): Bit score of 268.8 for HMM based on sequences of Figure 2
  misc_feature (1)..(341): Functional Homolog Of SEQ ID NO. 99
MSSETPEPAKLAIPWRTRLVLTMISAATDLSRRSNGTINRRLLNLLDFKSSPSPNKPIHSIISSDITVDPTRNLWFRLYTPENSGVDGSDTPSLPVVVFFHGGGFSFLSAASSSYDVVCRRFARIFPAIVLSVNYRLTPEHRFPCQYDDGFEVLRFLDNDRANGLLPPNADLSKCFLVGDSAGANLAHHVAVRACRAGFQNVKVIGLVSIQPYFGGQERTESELQLVGYPFVTVERTDWCWRVFLPDGSDRDHYAVNVSGPNAENISDLDFPDTIVIVGGFDPLQDWQRRYYEWLKRSGKEATLIEYSNMFHAFYIFPELPESSRLFSEIKEFVTKRLSKP

SEQ ID NO: 170 - protein, 367 aa, Oryza sativa
  misc_feature (1)..(367): Public GI ID no. 125533918
  misc_feature (1)..(367): Oryza sativa Indica Group
  misc_feature (107)..(332): Pfam Name: Abhydrolase_3 Pfam Description: alpha/beta hydrolase fold
  misc_feature (99)..(147): Pfam Name: COesterase Pfam Description: Carboxylesterase family
  misc_feature (1)..(367): Bit score of 260.7 for HMM based on sequences of Figure 2
  misc_feature (1)..(367): Functional Homolog Of SEQ ID NO. 99
MSSDDTTPTPPGRRTKPKPPMSRLMRLSLKAVDWATDATRRADGTLNRLALSVLDPRVPAFSSPCRGVASRDVLVHPPTRLRARLFYPSAAAGKDERPPPPRPLPVIVFFHGGGFAFLSAASAAYDAACRRIARYASAAVLSVDYRRAPEHRCPAAYDDGIAALRYLDDPKNHHGGGGGGVPPLDAARCYLAGDSAGGNIAHHVARRYACDAAAFENVRVAGLVAIQPFFGGEERTDSELRLDGAPIVTVSRTDWMWRAFLPDGCDRTHEAANFAAPSAAPGVDSPAFPPVLLAIGGYDPLQDWQRRYAEMLRGKGKDVRVFEYPNAIHAFYVFPAFDDGRDLMIRIAEFVAESAAAAAAAGGGGSE

SEQ ID NO: 171 - protein, 367 aa, Oryza sativa
  misc_feature (1)..(367): Public GI ID no. 297728173
  misc_feature (1)..(367): Oryza sativa Japonica Group
  misc_feature (107)..(332): Pfam Name: Abhydrolase_3 Pfam Description: alpha/beta hydrolase fold
  misc_feature (99)..(146): Pfam Name: COesterase Pfam Description: Carboxylesterase family
  misc_feature (1)..(367): Bit score of 258.7 for HMM based on sequences of Figure 2
  misc_feature (1)..(367): Functional Homolog Of SEQ ID NO. 99
MSSDDTTPTPLGRRTKPKPPMSRLMRLSLKAVDWATDATRRADGTLNRLALSVLDPRVPAFSSPCRGVASRDVLVHPPTRLRARLFYPSAAAGKDERPPPPRPLPVIVFFHGGGFAFLSAASAAYDAACRRIARYASAAVLSVDYRRAPEHRCPAAYDDGIAALRYLDDPKNHHGGGGGGVPPLDAARCYLGGDSAGGNIAHHVARRYACDAAAFENVRVAGLVAIQPFFGGEERTDSELRLDGAPIVTVSRTDWMWRAFLPDGCDRTHEAANFAAPSAAPGVDSPAFPPVLLAIGGYDPLQDWQRRYAEMLRGKGKDVRVFEYPNAIHAFYVFPAFDDGRDLMIRIAEFVAESAAAAAAASGGGSE

SEQ ID NO: 172 - protein, 343 aa, Physcomitrella patens
  misc_feature (1)..(343): Public GI ID no. 159902513
  misc_feature (104)..(321): Pfam Name: Abhydrolase_3 Pfam Description: alpha/beta hydrolase fold
  misc_feature (95)..(145): Pfam Name: COesterase Pfam Description: Carboxylesterase family
  misc_feature (1)..(343): Bit score of 284.1 for HMM based on sequences of Figure 2
  misc_feature (1)..(343): Functional Homolog Of SEQ ID NO. 99
MLYDLQMASMMQLRLLCKVVVKANDLARRKDGTINRWLADVCERKVPANPKPIKGVHTVDVTIDPEAGVWVRLFIPTEETVETPSKSASNDTQIESNKTMPIVYYYHGGGFTILCPDFYLYDVFCRRLAKCCKSVVISLHYRRAPEFKFPTAYDDSFKGLEWLQSEKATASLPLNVDFSRVFLCGDSAGANIAYHMALQSARKDLGRVSLKGVVIIQGFFGGEERTPAELRLKNVPLVSVESLDWYWKSYLPKGSNRDHPACNIFGPNSSDLSDVSLPPFLNIVGGLDILQDWEMRFAEGLQKAGKQVQTIFYEEGIHTFALLNQAKVGPKMFLDVAAFINSH

SEQ ID NO: 173 - protein, 335 aa, Vitis vinifera
  misc_feature (1)..(335): Public GI ID no. 225463177
  misc_feature (88)..(302): Pfam Name: Abhydrolase_3 Pfam Description: alpha/beta hydrolase fold
  misc_feature (82)..(130): Pfam Name: COesterase Pfam Description: Carboxylesterase family
  misc_feature (1)..(335): Bit score of 270.0 for HMM based on sequences of Figure 2
  misc_feature (1)..(335): Functional Homolog Of SEQ ID NO. 99
MTQSSPVLPWKTKIALSAISAVTDFSLRDDGTINRRLLSFLDFRAPPNSTPVHGVKTSDVTVDPSRNLWFRLFEPTEVPGRGEKLPVIVFFHGGGFAYLSAYSKAYDAVCRRFARKIPAIVASVNYRLSPEHRCPAQYDDGFDVLKYLDSQPPANSDLSMCFLVGDSAGANLAHNVTVRACETTTFREVKVVGLVPIQPFFGGEERTESERRLEGSPLVSMRRTDCMWKMFLPEGANRDHEAANVSGPRGRELSEVEFPATMVFIGGFDPLQDWQRRYCEWLKRSGKDVRVLEYGSAIHAFYVFPELPEASLLFAEVKNFVEKQKKTRRQNPSMI

SEQ ID NO: 174 - DNA, 1182 bp, Glycine max
  misc_feature (1)..(1182): Ceres Clone ID no. 566899
  misc_feature (1)..(1182): Encodes the peptide sequence at SEQ ID NO. 175
atttttaaaaatcgcgtcctcttggcttattctgtgcaattctccatctctagtctttactcacagagtcactcaaatggcttccgaaaccccaaagccaaaacccgttctaccgtggaaaacccgcgtttcaatttcctttctctctaccctaacggactatgcacgccgttctaacggcaccgttaaccgccgtctcatgaacttcctcgatcgcaaatcccaacctaacgccaaacccgttaacggtgtttccacccaagacgtcaccgtcgacgccaaacggaacctctggttccgaatctttaaccccgcagccgcctccggcggcggcctccccgtcgttattttcttccacggcggcggcttcgcgttcctctcgccggattcgtttgcctacgacgccgtctgccggcggttctgccggcgagtccccgccgtcgtcgtctccgtcaactaccgcctcgcgccggagcaccggtaccctttgcaatacgacgacggtgaggacatcctcagattcctcgacgagaaccgcgcggtgctgccggaaaatgctgacgtatcaaaatgcttcctcgccggcgacagcgccggcgcgaatttggcacacaatgtggcggttcgggttgccaagtcgggtccgctccgggaagttcgggttgtggggttggtatcgatccaaccgtggtttggcggggaggcacggaccgcggcggaggtgaagttcgagggggcgccgctggtgtcaacggcaaggacggactggctgtggaaggcgtttttgccagacgggtcggaccgtgaccacggggcttcgaatgtgagcgggccgaattctgaggatttgtcgggtttgaattacccggatacccttgtgtttgtgggtgggtttgacccattgcaagattggcaaaagaagtattgtgagtggttgaagaaatcagggaaaaaggctcaattgattgagtattcaactatgattcatgcattttatatatttcctgaattgcccgagtcatctcagttgatctcagaggttaaggatttcatcaccaagagaatttccgatttaaaatcaaatatgtaataagttcatgttggagtcaagtgtaaggctatgcaagttcttgtttcaagtcttctagaaaaaataaaaaaggtcccaagtattagactatt

SEQ ID NO: 175 - protein, 337 aa, Glycine max
  misc_feature (1)..(337): Ceres Clone ID no. 566899
  misc_feature (90)..(307): Pfam Name: Abhydrolase_3 Pfam Description: alpha/beta hydrolase fold
  misc_feature (76)..(132): Pfam Name: COesterase Pfam Description: Carboxylesterase family
  misc_feature (1)..(337): Bit score of 272.3 for HMM based on sequences of Figure 2
  misc_feature (1)..(337): Functional Homolog Of SEQ ID NO. 99
MASETPKPKPVLPWKTRVSISFLSTLTDYARRSNGTVNRRLMNFLDRKSQPNAKPVNGVSTQDVTVDAKRNLWFRIFNPAAASGGGLPVVIFFHGGGFAFLSPDSFAYDAVCRRFCRRVPAVVVSVNYRLAPEHRYPLQYDDGEDILRFLDENRAVLPENADVSKCFLAGDSAGANLAHNVAVRVAKSGPLREVRVVGLVSIQPWFGGEARTAAEVKFEGAPLVSTARTDWLWKAFLPDGSDRDHGASNVSGPNSEDLSGLNYPDTLVFVGGFDPLQDWQKKYCEWLKKSGKKAQLIEYSTMIHAFYIFPELPESSQLISEVKDFITKRISDLKSNM

SEQ ID NO: 176 - protein, 349 aa, Picea sitchensis
  misc_feature (1)..(349): Public GI ID no. 294460127
  misc_feature (103)..(324): Pfam Name: Abhydrolase_3 Pfam Description: alpha/beta hydrolase fold
  misc_feature (90)..(142): Pfam Name: COesterase Pfam Description: Carboxylesterase family
  misc_feature (1)..(349): Bit score of 277.7 for HMM based on sequences of Figure 2
  misc_feature (1)..(349): Functional Homolog Of SEQ ID NO. 99
MSQVQTPASSSSEILISRDAKPASFPLGLRLLCRILNSVNDLARRKDGTFNRRIMNWIEYKTPANGTPTRGVYTKDVVIDAQTGVQVRLFIPVEAPEKPLPVVFFFHGGGFATLSSEFVLYDIFCRRLARRRRVLVISVDYRRSPEHRFPIPYDDCVGAIRWFSSGNGKAHLPAHADLSRCFLMGDSAGANIVHHVGCRVLAAAEETMSGVRIVGHVLLQPFFGGEKRTPSEARLVGAPIVNMENSDWHWKAFLPVGADRDHPAANVFGPNAPDISALPLPPTLVVVGGHDPLQDWQLGYVEHLRKIKKDVELLFYGEGIHGFHVFYQIEVSSKLISELRSFMTRCCEK

SEQ ID NO: 177 - protein, 335 aa, Vitis vinifera
  misc_feature (1)..(335): Public GI ID no. 147856212
  misc_feature (88)..(302): Pfam Name: Abhydrolase_3 Pfam Description: alpha/beta hydrolase fold
  misc_feature (83)..(130): Pfam Name: COesterase Pfam Description: Carboxylesterase family
  misc_feature (1)..(335): Bit score of 268.8 for HMM based on sequences of Figure 2
  misc_feature (1)..(335): Functional Homolog Of SEQ ID NO. 99
  misc_feature (81)..(81): Xaa is any aa, unknown, or other
  misc_feature (124)..(124): Xaa is any aa, unknown, or other
  misc_feature (134)..(134): Xaa is any aa, unknown, or other
  misc_feature (232)..(232): Xaa is any aa, unknown, or other
MTQSSPVLPWKTKFVLSVLSAVTDFARRDDGTINRRLLSFLNFRAPPNSTPVNGVKTSDVTVDPSRNLWFRLFEPTEVPGXGEKLPVIVFFHGGGFAFMSADSKAYDAVCRRFARKIPAIVASXNYRLSPEHRXPAQYDDGFDVLKYLDSQPPANSDLSMCFLVGDSAGANLAHNLTVRACETTTFREVKVVGLVPIQPFFGGEERTESERRLEGSPLVSMRRTDCMWKMFXPEGADRDHEAANVSGPRGRELSEVEFPATMVFIGGFDPLQDWQRRYCEWLKRSGKEVRVLEYGSAIHAFYIFPELPEASLLFAEVKNFVEKQKKTHRQYPSMI

SEQ ID NO: 178 - DNA, 1334 bp, Glycine max
  misc_feature (1)..(1334): Ceres Clone ID no. 1647753
  misc_feature (1)..(1334): Encodes the peptide sequence at SEQ ID NO. 179
aattcacctcttcgtttcactctccgagtcaaccgagtcaactcaccaccaccaatgcctccgtccaccaaaccgaaccttccttggaagcttcgcatattgacctctctcctcaacctcctcatcaacgcctctcgccgctccaatggcaccgtcaaccgccgtctcttcaacttcttcgaccgcaagctcccctctagccccaaccccgtcgacggtgtcaaaacctccgacgtcaccgtcgacgccacccgcaacctctggttccgcctcttcgccccttcctcctccgtcgccaccacccttcccgtcgtcatcttcttccacggcggcggcttcgcgttcctctccccggcttcagccgcatacgacgccgtttgtcgcttcttctgccgctccttcaatgccgttattatctccgttaactaccgtctcgcccccgaacaccgttacccctcccaaaacgacgacgggttcgacgtgattaaatacctcgacgaaaacggcgccgttttgggtgacattaataattgttttttggtaggtgatagttcgggcgggaacatagcgcaccacgtggcggttcgggtttgcaaagagaagttccggttcgtgagagttatcgggttggtttcaattgaaccgtttttcggaggggaagaacgaaccgaatccgagatccggatgacgcaagacccgttggtttcgttggagaaaacggattggtattggaagtcgtttttgccaagcgggctgggccgggaccatgaagcggtaaacgtgagtgggcccaatgcggtgaatatttcgggtttgggttatccgaatacgcttgttgtgattgcgggttttgacccgttacaggattggcagaggaggtactatgagtggttaagaaaatcgggtattgaggcacagaaaattgagtacccgaatatgattcatggttttcacttgtttccggatttgcccgactcttctgtgtttgcttctgatgtcaaggatttcatcaccaagcaaattgccgacgtgaattaagagggtttaaatttgtgcaattagttgtgatagtattgaagagagaaattatttgcctttaatttgtatgaaaagcgaaagacagaaatttgatagacgtggtgtatttatgttatgaaattgatatggacatatcatatggtggttgggtagtagttgtatcatatatgcattaggttgtcatgcatgttaaagtcaaagatcattgatggagttgctctaaaacctctcttattctcttgtatgtataataatgcattgatctttttcgtattgtataggtgatatttttttct

SEQ ID NO: 179 - protein, 327 aa, Glycine max
  misc_feature (1)..(327): Ceres Clone ID no. 1647753
  misc_feature (87)..(300): Pfam Name: Abhydrolase_3 Pfam Description: alpha/beta hydrolase fold
  misc_feature (74)..(129): Pfam Name: COesterase Pfam Description: Carboxylesterase family
  misc_feature (1)..(327): Bit score of 257.7 for HMM based on sequences of Figure 2
  misc_feature (1)..(327): Functional Homolog Of SEQ ID NO. 99
MPPSTKPNLPWKLRILTSLLNLLINASRRSNGTVNRRLFNFFDRKLPSSPNPVDGVKTSDVTVDATRNLWFRLFAPSSSVATTLPVVIFFHGGGFAFLSPASAAYDAVCRFFCRSFNAVIISVNYRLAPEHRYPSQNDDGFDVIKYLDENGAVLGDINNCFLVGDSSGGNIAHHVAVRVCKEKFRFVRVIGLVSIEPFFGGEERTESEIRMTQDPLVSLEKTDWYWKSFLPSGLGRDHEAVNVSGPNAVNISGLGYPNTLVVIAGFDPLQDWQRRYYEWLRKSGIEAQKIEYPNMIHGFHLFPDLPDSSVFASDVKDFITKQIADVN

SEQ ID NO: 180 - protein, 355 aa, Oryza sativa
  misc_feature (1)..(355): Public GI ID no. 115473685
  misc_feature (1)..(355): Oryza sativa Japonica Group
  misc_feature (104)..(326): Pfam Name: Abhydrolase_3 Pfam Description: alpha/beta hydrolase fold
  misc_feature (87)..(146): Pfam Name: COesterase Pfam Description: Carboxylesterase family
  misc_feature (1)..(355): Bit score of 253.4 for HMM based on sequences of Figure 2
  misc_feature (1)..(355): Functional Homolog Of SEQ ID NO. 99
MGHEKEQETAGDELRRPEPPALPWTVRLQLFALVTAVDIVQRGDGTVNRFLFSLADRQSAAAARPDAHGVRSGDVTVDASRGLWARVFSPASSSAVESPPLPVVVYFHGGGFALLTAASSQYDALCRRLCRELRAVVVSVNYRLAPEHRYPAAYDDGVDVLRHLATVGLPADVVAAVPVDLTRCFLVGDSAGGNIAHHVAHRWAAATTSSSRRVRLAGVVLLQPFFGGEERTEAELRLDGVGPVVSMARADWCWRAFLPEGADRDHPAAHVTGENAELAEEFPPAMVVVGGYDTLQDWQRRYAGMLRRNGKAVQVVEYPAAIHSFYVFPELADSGELVKEMKAFMERNAPPKSNA

SEQ ID NO: 181 - protein, 340 aa, Malus pumila
  misc_feature (1)..(340): Public GI ID no. 82697933
  misc_feature (100)..(318): Pfam Name: Abhydrolase_3 Pfam Description: alpha/beta hydrolase fold
  misc_feature (93)..(141): Pfam Name: COesterase Pfam Description: Carboxylesterase family
  misc_feature (1)..(340): Bit score of 250.3 for HMM based on sequences of Figure 2
  misc_feature (1)..(340): Functional Homolog Of SEQ ID NO. 99
MTTSLDSSTQKTAPSWTSLPWRTRVSLSVLSKITDAARRADGTVNRRLMNILDFKSSATPAAPVRGVTSSDVTVDPARKLWFRLFVPQSTLSTPSDLPVIVFFHGGGFTFLSPASFAYNAVCRKFARKFPAVVVSVNYRLCPEHRYPSPYDDGFDVLTFLDQNDDVLPKNADRSRIFLAGDSAGANVAHHVAVRAAREKDRMRVVKPVGLISIQPFFGGEERVESEIRLRGAPLVSVGRTDWLWKVFLPDGSNRDHEAANVSGPNAVDISGLEYPNTIVFTGGLDPLLDRQRRYYQWLKKSGKEAKLIEYPNMVHAFYVFPELPESNQLINQVKDFIASV

SEQ ID NO: 182 - protein, 328 aa, Selaginella moellendorffii
  misc_feature (1)..(328): Public GI ID no. 302788858
  misc_feature (82)..(305): Pfam Name: Abhydrolase_3 Pfam Description: alpha/beta hydrolase fold
  misc_feature (63)..(173): Pfam Name: COesterase Pfam Description: Carboxylesterase family
  misc_feature (1)..(328): Bit score of 239.0 for HMM based on sequences of Figure 2
  misc_feature (1)..(328): Functional Homolog Of SEQ ID NO. 99
MGDEERKSSGKQIGGFVFAEDGSYVRTPPPTGPAGFFEEVPANPSFIDGVASRDVILDKDRGLWVRVFRPEELENRSTLPIVIFYHGGGFIYMSAANAIFHRFCEALSRKLGAIVVSVNYRLAPEHRLPAAYDDGYDALKWVRGIAKSSSDQDAFAHADFSKIFVMGDSAGGNLAARVALRAAQDGIPLAGQILLQPFYGGTSRTESELRLGSSNPMITLDSSDFCWLATLPEGAADRDHPFCNPTLELPGDLARLGARGLARALVVVGGKDLLHDRQVEFAKILEDAGNTVKLIEYENASHGFYAVGDASCQESVLVLDEIASFLRE

SEQ ID NO: 183 - protein, 320 aa, Physcomitrella patens
  misc_feature (1)..(320): Public GI ID no. 168013809
  misc_feature (1)..(320): Physcomitrella patens subsp. patens
  misc_feature (81)..(298): Pfam Name: Abhydrolase_3 Pfam Description: alpha/beta hydrolase fold
  misc_feature (68)..(122): Pfam Name: COesterase Pfam Description: Carboxylesterase family
  misc_feature (1)..(320): Bit score of 269.5 for HMM based on sequences of Figure 2
  misc_feature (1)..(320): Functional Homolog Of SEQ ID NO. 99
MQLRLLCKVVVKANDLARRKDGTINRWLADVCERKVPANPKPIKGVHTVDVTIDPEAGVWVRLFIPTEETIESNKTMPIVYYYHGGGFTILCPDFYLYDVFCRRLAKCCKSVVISLHYRRAPEFKFPTAYDDSFKGLEWLQSEKATASLPLNVDFSRVFLCGDSAGANIAYHMALQSARKDLGRVSLKGVVIIQGFFGGEERTPAELRLKNVPLVSVESLDWYWKSYLPKGSNRDHPACNIFGPNSSDLSDVSLPPFLNIVGGLDILQDWEMRFAEGLQKAGKQVQTIFYEEGIHTFALLNQAKVGPKMFLDVAAFINSH

SEQ ID NO: 184 - protein, 328 aa, Selaginella moellendorffii
  misc_feature (1)..(328): Public GI ID no. 302788854
  misc_feature (82)..(305): Pfam Name: Abhydrolase_3 Pfam Description: alpha/beta hydrolase fold
  misc_feature (63)..(173): Pfam Name: COesterase Pfam Description: Carboxylesterase family
  misc_feature (1)..(328): Bit score of 239.1 for HMM based on sequences of Figure 2
  misc_feature (1)..(328): Functional Homolog Of SEQ ID NO. 99
MGDEERKSSGKQIEGFVFAEDGSYVRTPPPTGPAGFFEEVPANPSFIDGVASRDVILDKDRGLWVRVFRPEELENRSTLPIVIFYHGGGFIYLSAANAIVHRFCEALSRKLGAIVVSVNYRLAPEHRLPAAYDDGYDALKWVRGIAKSSSDQDAFAHADFSKIFVMGDSAGGNLAARVALRAAQDGIPLAGQILLQPFYGGTSRTESELKLGSSNPMITLDTTDFCWLATLPEGAADRDHPFCNPTLEFPGDLARLGAGELPRALVVVGGKDLLYDRQVEFARILEDAGNAVKLIDYENASHGFYAVGDASCQEYVLVLDEIASFLRE

SEQ ID NO: 185 - protein, 357 aa, Sorghum bicolor
  misc_feature (1)..(357): Public GI ID no. 242068025
  misc_feature (105)..(331): Pfam Name: Abhydrolase_3 Pfam Description: alpha/beta hydrolase fold
  misc_feature (93)..(144): Pfam Name: COesterase Pfam Description: Carboxylesterase family
  misc_feature (1)..(357): Bit score of 243.7 for HMM based on sequences of Figure 2
  misc_feature (1)..(357): Functional Homolog Of SEQ ID NO. 99
MGEAAADPAPAAAKGRVAPPMSWRTRLSVLAAGYLTDATRRADGTVNRRLLAVLDKPVAASATPRNGVASRDVTIDPALPLRARLFYPCAPAPADAAEAAAVPVVVFFHGGGFAYLSAASLAYDAACRRIARYAGAAVLSVDYRRSPEHRFPAAYDDGYAALRFLDGPDPDHPGALAVAPPIDAARCFVAGDSAGGNIAHHVARRYALDPSAFASLRLAGLIAIQPFFGGEERTPAELRLVGAPIVSVPRTDWMWRAFLPHGADRDHEASSPEAATAGIDLDAAGSFPPATVVVGGYDPLQDWQRRYCDALRGKGKEVRVLEYPDAIHAFYVFPEFAESKDLMLRIKEIVAGSSSSE

SEQ ID NO: 186 - protein, 327 aa, Selaginella moellendorffii
  misc_feature (1)..(327): Public GI ID no. 302769524
  misc_feature (81)..(304): Pfam Name: Abhydrolase_3 Pfam Description: alpha/beta hydrolase fold
  misc_feature (63)..(175): Pfam Name: COesterase Pfam Description: Carboxylesterase family
  misc_feature (1)..(327): Bit score of 234.1 for HMM based on sequences of Figure 2
  misc_feature (1)..(327): Functional Homolog Of SEQ ID NO. 99
MGEEERKSSGKQIGGFVFAEDGSYVRAPPPTGPAGFFAEVPANPAFIDGVASRDVTLDKDRGLWVRVFRPEELGNRTLPIVIFYHGGGFIYMSAANAIFHRFCEALSRKLGAIVVSVNYRLAPEHRLPAAYDDGYDALNWVREIAKSSSDQDAFAHADFSKIFVMGDSAGGNLAARVALRAAQDGIPLAGQILLQPFYGGTSRTESELKLGSSNPMITLDSSDFCWLATLPEGAADRDHPFCNPMVELPGDLERLGAGGLPRALVVVGGKDLLHDRQVEFAKILEDAGNAVKLIEYENASHGFYAAGDDSCQEYVLVLDEIASFLRE

SEQ ID NO: 187 - protein, 351 aa, Cucumis melo
  misc_feature (1)..(351): Public GI ID no. 148270935
  misc_feature (92)..(309): Pfam Name: Abhydrolase_3 Pfam Description: alpha/beta hydrolase fold
  misc_feature (78)..(134): Pfam Name: COesterase Pfam Description: Carboxylesterase family
  misc_feature (1)..(351): Bit score of 244.3 for HMM based on sequences of Figure 2
  misc_feature (1)..(351): Functional Homolog Of SEQ ID NO. 99
MADDHPPLQNPQKLPLKYRLILPLLSFVSHKCLRPNMTVNRSLISLFESKVSSSSPRDGVFTCDTVIDPSRNLWFRLFVPSSTPHDLPIPLLIYFHGGGFVFFSPDFLSFDTLCRKLARELQAIVVSVNYRLSPEHRYPSQYEDGFDALKFIDDLDSSAFPKKSDFGRCFIAGDSAGGNIAHHVVVRSSDYNFKKVKIRGLIAIQPFFGGEERTESEIRFGRSPTLNLERADWYWKAFLPDGANRNHGAAHVFGEDGVNISAVKFPATLVIVGGSDQLRDWDRKYYEWLKKAGKEVELVEYPKAIHGFYVISELPETWLLIEEAKNFIEKVRSSVNHEWNGIEDDDRSHQM

SEQ ID NO: 188 - protein, 625 aa, Oryza sativa
  misc_feature (1)..(625): Public GI ID no. 75139772
  misc_feature (1)..(625): Oryza sativa Japonica Group
  misc_feature (241)..(621): Pfam Name: GRAS Pfam Description: GRAS family transcription factor
  misc_feature (39)..(113): Pfam Name: DELLA Pfam Description: Transcriptional regulator DELLA protein N terminal
  misc_feature (1)..(625): Bit score of 1168.3 for HMM based on sequences of Figure 3
  misc_feature (1)..(625): in Figure 3
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCHRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 189 - protein, 532 aa, Arabidopsis thaliana
  misc_feature (1)..(532): Public GI ID no. 2569938
  misc_feature (168)..(528): Pfam Name: GRAS Pfam Description: GRAS family transcription factor
  misc_feature (27)..(97): Pfam Name: DELLA Pfam Description: Transcriptional regulator DELLA protein N terminal
  misc_feature (1)..(532): Bit score of 770.8 for HMM based on sequences of Figure 3
  misc_feature (1)..(532): Functional Homolog Of SEQ ID NO. 188
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRKVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 190 - protein, 635 aa, Malus x domestica
  misc_feature (1)..(635): Public GI ID no. 66816765
  misc_feature (267)..(626): Pfam Name: GRAS Pfam Description: GRAS family transcription factor
  misc_feature (51)..(119): Pfam Name: DELLA Pfam Description: Transcriptional regulator DELLA protein N terminal
  misc_feature (1)..(635): Bit score of 938.5 for HMM based on sequences of Figure 3
  misc_feature (1)..(635): Functional Homolog Of SEQ ID NO. 188
MKGEHQIHQLNQYPLPQQHPDPSMASASAGGGFGKAKMWEDESQRMDGGMDELLAVLGYKVRSSDMADVAQKLEQLEEFMSCAQEDGLSQLASDTVHYNPSDLSTWLETMISEINVPPPNFDPLMGGAVAGIQLSQQQVQLVDDPFLAPAESSITTVDFPDHRKSKSMSTSPTQNVFEDCNSSSSYYDFKSIPGNAVFTITRLDSSSREPKRLKSSSGSSPSDLLFNRPAASSLPQPQQPISLPAPAESSSTRPALLVDSQENGVRLVHGLMACAEAVQQNNFNLAKALVTQIGYLAGSQAGAMRKVATFFAEALAHRIFRVYPQPPIDHSFSDMLQMHFYETCPYLKFAHFTANQAILESLQGKTRVHVIDFSMNQGMQWPALMQALALRPGGPPAFRLTGIGPPASDNSDHLQEVGWKLAQLAETIHVEFEYRGFVANSLADLDASMLELRPSEAESVAVNSVFELHKLLARPGAIEKVLSVVKQMKPEILTVVEQEANHNGPVFMDRFNESLHYYSTLFDSLEGSANSQDKVMSEVYLGKQICNVVACEGLDRVERHETLTQWRARFDSADFVPVHLGSNAFKQASMLLALFAGGDGYRVEENDGCLMLGWHTRPLIATSAWKPSFNSVIAH

SEQ ID NO: 191 - protein, 528 aa, Antirrhinum majus
  misc_feature (1)..(528): Public GI ID no. 282759334
  misc_feature (160)..(526): Pfam Name: GRAS Pfam Description: GRAS family transcription factor
  misc_feature (39)..(104): Pfam Name: DELLA Pfam Description: Transcriptional regulator DELLA protein N terminal
  misc_feature (1)..(528): Bit score of 792.2 for HMM based on sequences of Figure 3
  misc_feature (1)..(528): Functional Homolog Of SEQ ID NO. 188
MKRDSSMNNNNNNNQAEQKSSSSKNMWPSSSCEATDEVDELFAVLGYKVKPSDMADVAIKIQQLEQVMGNGAAVSDLASDTVHYNPSDLSSWLESMITGLNQFDPPPPTQMDFGSDLVAIPGEAAMYPQPPPIKKLKTTPHQEQPPKVVLVDSQENGVRLVHTLMACAEAVQQENFKLAETLVKNIGFLAVSQVGAMRKVATYFAEALARRIYRLYPTSNLQDSAFTDLLQMHFYETCPYLKFAHFTANQAILEAFAGKTRVHVIDFSMKQGMQWPALLQALALRPGGPPSFRLTGVGPPSPDNTDHLQEVGWKLAQLAESINVEFEYRGFVANSLADLNASMFDVREGETVAVNSIFELHQLLARGGAIEKVLGVVRELKPEILTVVEQEANHNGVAFLDRFTESLHYYSTLFDSLESCGGGVEGGVVSDQDKVMSEVYLGRQICNVVACEGVDRVERHESLVQWRTRFNGAGFKPVHLGSNAYKQASMLLALFAGGDGYRVEENDGCLMLGWHTRPLIATSAWRPS

SEQ ID NO: 192 - DNA, 2405 bp, Gossypium hirsutum
  misc_feature (1)..(2405): Ceres Clone ID no. 1884375
  misc_feature (1)..(2405): Encodes the peptide sequence at SEQ ID NO. 193
aacatatatttatttaaaatctttttttctttttttcttttttatgtaattgctctgatgatgaagtgggagtagtagggaaaaaccaagcaaaaccccccaatccccaatgctcagattcttcacccattcatcttttttctttggtttttgagcatcaccacacaaatccatagatacctcccctccacccccctctcaacccacaattttacacaggagaaatttatcacaatcatgaagcgagaccacaatcatctccaacccaacccagacccctcttctctccgcggcgctccttcaaccggaaaggccaaggtttgggacgaagaatccgcccaacaagactgtgggatggatgagcttttggcggttttgggttacaaggtcaaaacttcagacatggctgaagtggctcaaaagcttgagcagttggaggaggttatgtgtaatgttcaagatgatgggatttctcaccttgcttctgaaactgttcattataatccttccgatctgtcgacttggctcgagagcatgctctctgaacttaaccctccctccacttttgatccttttggcgctgctgggacggcggcggcggcgttggatgattcgtttcttgtccccgctgagtcctcaactttgacgacgttggatttcgacaacatcaatcggaaacatcagaaatctggtcaacaaatctttgaggaagcttcctgctccgattacgatctcaaagccattcctggtaaggctatttattctcaaaaaacccaaccccaaacccacgattcctcatcttcttccacacccaccaacgttaaatctgaaaaacgcttcaaatccacatccgggccgccctcgccctcggatatcttcccccctcctcctcctcccgctgctgcttcctatggaattccgactgcttcaactcgtcccgtggtcctggttgactcgcaagaaaatggaatccggcttgtccatgctttgatggcatgtgcggaagctgtccagcaaaacaatcttaatctagctgaagctttagttaaacaaattgggttcctagcgatttctcaagctggggctatgagaaaagtggctacttattttgcggaagcattagcccgaaggatttacagattttatcctcaaaacccactcgaccactctttttcagatgttcttcacatgcacttttacgagacttgcccctatctcaagttcgctcatttcaccgctaaccaagctattctcgaagcttttgagggcaaaaaaagagtccatgttatcgatttctcaatgaaccaaggcatgcaatggcctgctttgatgcaagctttagcgttaagagttggtggtccgccagcttttaggttaactgggttcggacctcctagccacgacaactcagatcacttgcaggaagttggttgtaagttggctcagtttgccaaaaagattcacgtggagttcgagtatcgtgggttcgtggctaattcgttggccgatttggatgcttcaatgcttgatctcaggccgagtgaagttgaagccgtggccgttaactcggttttcgagttacataaattgttggctcggcctggtgccatcgacaaagtcttttctgtggtgaaacaaatgaagcctgaacttgttaccatcgttgagcaagaagcgaaccacaacggtcctgttttcttagaccggttcactgagtcattacatttttactcgacgctttttgattcgttggaggggtcggtgagcagtcaggataaggttatgtcggaggtgtatttggggaaacagatatgcaatgtggtggcctgtgaaggggtggaccgaatcgagaggcacgagtcgctgactcagtggagaaaccggttgagtacggcggggttttcaccggttcatttgggttcgaacgcgttcaagcaagctagtatgttgttggccctttttgcaggcggagatgggtatggggtggaagagaacaacgggtgtttgatgctgggatggcacaaccgcccactcattacaacttcagcttggaagctcaccaacaaaaccaccgccataagccagtaaaatttatttatttttaatgagtcgactcaatgagtctaagaagaatcccaactcagtctggtccctccctagtacgaaacccttatctttaatttctgtcaatgttggcttctgaactggtgcctttccagtttgccactcgctttttatcatttttctaattttcagctctctttctgtttaagttaaattttttttcttggggaaatctttttgtattttcagggtgaatcactaaaagggttaatgtatttattataaatatgttatatagcgttgctgaaaaataaaaaagaaattgcagaggggtttagttg

SEQ ID NO: 193 - protein, 616 aa, Gossypium hirsutum
  misc_feature (1)..(616): Ceres Clone ID no. 1884375
  misc_feature (247)..(606): Pfam Name: GRAS Pfam Description: GRAS family transcription factor
  misc_feature (41)..(109): Pfam Name: DELLA Pfam Description: Transcriptional regulator DELLA protein N terminal
  misc_feature (1)..(616): Bit score of 958.7 for HMM based on sequences of Figure 3
  misc_feature (1)..(616): Functional Homolog Of SEQ ID NO. 188
MKRDHNHLQPNPDPSSLRGAPSTGKAKVWDEESAQQDCGMDELLAVLGYKVKTSDMAEVAQKLEQLEEVMCNVQDDGISHLASETVHYNPSDLSTWLESMLSELNPPSTFDPFGAAGTAAAALDDSFLVPAESSTLTTLDFDNINRKHQKSGQQIFEEASCSDYDLKAIPGKAIYSQKTQPQTHDSSSSSTPTNVKSEKRFKSTSGPPSPSDIFPPPPPPAAASYGIPTASTRPVVLVDSQENGIRLVHALMACAEAVQQNNLNLAEALVKQIGFLAISQAGAMRKVATYFAEALARRIYRFYPQNPLDHSFSDVLHMHFYETCPYLKFAHFTANQAILEAFEGKKRVHVIDFSMNQGMQWPALMQALALRVGGPPAFRLTGFGPPSHDNSDHLQEVGCKLAQFAKKIHVEFEYRGFVANSLADLDASMLDLRPSEVEAVAVNSVFELHKLLARPGAIDKVFSVVKQMKPELVTIVEQEANHNGPVFLDRFTESLHFYSTLFDSLEGSVSSQDKVMSEVYLGKQICNVVACEGVDRIERHESLTQWRNRLSTAGFSPVHLGSNAFKQASMLLALFAGGDGYGVEENNGCLMLGWHNRPLITTSAWKLTNKTTAISQ

SEQ ID NO: 194 - protein, 630 aa, Zea mays
  misc_feature (1)..(630): Public GI ID no. 75207626
  misc_feature (243)..(623): Pfam Name: GRAS Pfam Description: GRAS family transcription factor
  misc_feature (38)..(114): Pfam Name: DELLA Pfam Description: Transcriptional regulator DELLA protein N terminal
  misc_feature (1)..(630): Bit score of 1174.3 for HMM based on sequences of Figure 3
  misc_feature (1)..(630): Functional Homolog Of SEQ ID NO. 188
  misc_feature (1)..(630): in Figure 3
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAP

SEQ ID NO: 195 - protein, 625 aa, Zea mays
  misc_feature (1)..(625): Public GI ID no. 115184057
  misc_feature (236)..(621): Pfam Name: GRAS Pfam Description: GRAS family transcription factor
  misc_feature (37)..(110): Pfam Name: DELLA Pfam Description: Transcriptional regulator DELLA protein N terminal
  misc_feature (1)..(625): Bit score of 1137.9 for HMM based on sequences of Figure 3
  misc_feature (1)..(625): Functional Homolog Of SEQ ID NO. 188
MKREYQNAGGNDGYRGSSKDKSMAAAAGAGEQEEEVDELLAALGYKVRSSDMADVAQKLEQLEMAMGMGGACPTADDGFVSHLATDTVHYNPSDLSSWVESMLSELNAPPPPLPPATPAPRLASTSSTVTSGAAAGAGYFDLPPAVDSSSSTYALKPIPSPVAAASADPSPDSAREPKRMRTGGGSTSSSSSSSSSMDGGRTRSSVVEAAPPATQAANGPAVPVVVVDTQEAGIRLVHALLACAEAVQQENFSAADALVKQIPVLASSQGGAMRKVAAYFGEALARRVYRLRPAPDGSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLRPEGGGDTDDEPEVIAVNSVCELHRLLAQPGTLDKVLGTVRAVRPRIVTVVEQEANHNSGTFLDRFTESLHYYSTMFDSLEGAGSGSGSGSGSGQPTDASPPAGTDQVMSEVYLGRQICNIVACEGAERTERHETLVQWRGRLGGSGFEPVHLGSNAYKQASTLLALFAGGDGYRVEEKDGCLTLGWHTRPLIATSAWRVAAP

SEQ ID NO: 196 - protein, 613 aa, Vitis vinifera
  misc_feature (1)..(613): Public GI ID no. 225451399
  misc_feature (231)..(594): Pfam Name: GRAS Pfam Description: GRAS family transcription factor
  misc_feature (46)..(115): Pfam Name: DELLA Pfam Description: Transcriptional regulator DELLA protein N terminal
  misc_feature (1)..(613): Bit score of 1102.9 for HMM based on sequences of Figure 3
  misc_feature (1)..(613): Functional Homolog Of SEQ ID NO. 188
  misc_feature (1)..(613): in Figure 3
MKRDLLDGCGGGGGGGGGGKGEEGSSMVSAKGKMWDDGQQQDAGMDELLAVLGYNVRSSDMVDVAQKLEQLEMVMGNAQEDGISHLSSGTVHYNPSDLSGWVQSMLTELNPPSSAFASSSQQTPIDDPLLAPSESSTITTLDFSGSRQQSEHQSRIYNDNSDYDLSAIPGVAVYRRPDQQGDGEKSSKRMKTASSSSSSSTQQVQENGLASVAESTRPVVVVDSQETGVRLVHTLMACADAVQQDNMKLADALVKHIGLLAASQAGAMRKVATYFAEALARRIYRIYPQDSLESSYSDILQMHFYEACPYLKFAHFTANQAILEAFAGANRVHVIDFGLKQGMQWPALMQALALRPGGPPSFRLTGIGPPQPDNTDALQQVGWKLAQLAETIGVEFEFRGFVANSLADLEPSMLQIRPPEVEAVAVNSVLELHRLLARPGAIEKVLSSIKAMKPKIVTVVEQEASHNGPVFLDRFTEALHYYSNLFDSLEGCGVSPPSSQDLMMSEIYLGRQICNVVACEGAERVERHETLSQWRSRMGSAGFDPVHLGSNAFKQASMLLALFAGGDGYRVEENNGCLMLGWHTRPLIATSAWQLNSNFNPTSTSASTSAHSQ

SEQ ID NO: 197 - protein, 538 aa, Dubautia raillardioides
  misc_feature (1)..(538): Public GI ID no. 20257430
  misc_feature (189)..(538): Pfam Name: GRAS Pfam Description: GRAS family transcription factor
  misc_feature (24)..(90): Pfam Name: DELLA Pfam Description: Transcriptional regulator DELLA protein N terminal
  misc_feature (1)..(538): Bit score of 750.0 for HMM based on sequences of Figure 3
  misc_feature (1)..(538): Functional Homolog Of SEQ ID NO. 188
MKRSRERKKEAKITSSVPDSGGMDELLEVLGYKVKSTDMADVAQKLEQLEMVMGEDGVLQLSDTVHYNPSDLSGWVQSMLSVLNDYNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVVILVASQAGAMAKVSTYFAGALAQRIYNIYPQNALETSCYEILQMHFYETCPYLKFAHFTANQAILEAFAGATRVHVIDFSLKQGMQWPALMQALALRYDGPPAFRLTGIGPPQPDNSDALQQVGWKLAQLADTIGVEFEFRGFVANSIADIDADMLDIRASETEVVTVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 198 - protein, 541 aa, Argyroxiphium sandwicense
  misc_feature (1)..(541): Public GI ID no. 20257459
  misc_feature (1)..(541): Argyroxiphium sandwicense subsp. macrocephalum
  misc_feature (192)..(541): Pfam Name: GRAS Pfam Description: GRAS family transcription factor
  misc_feature (24)..(91): Pfam Name: DELLA Pfam Description: Transcriptional regulator DELLA protein N terminal
  misc_feature (1)..(541): Bit score of 860.5 for HMM based on sequences of Figure 3
  misc_feature (1)..(541): Functional Homolog Of SEQ ID NO. 188
MKRSRERKKEAKTTSSVPDSGGMDELLEVLGYKVKSTDMADVAQKLEQLEMVMGEDGILQLSDTVHYNPSDLSGWVQSMLLVLNDNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHKDLKLADALVKHVGILVASQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAAEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 199 - protein, 536 aa, Dubautia menziesii
  misc_feature (1)..(536): Public GI ID no. 20257428
  misc_feature (187)..(536): Pfam Name: GRAS Pfam Description: GRAS family transcription factor
  misc_feature (24)..(87): Pfam Name: DELLA Pfam Description: Transcriptional regulator DELLA protein N terminal
  misc_feature (1)..(536): Bit score of 869.7 for HMM based on sequences of Figure 3
  misc_feature (1)..(536): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKLVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 200 - DNA, 2438 bp, Panicum virgatum
  misc_feature (1)..(2438): Ceres Clone ID no. 1776298
  misc_feature (1)..(2438): Encodes the peptide sequence at SEQ ID NO. 201
gccttcgcggcccccttcccctgccactagcccactactactagttgccttgctcgcttcccacccctctcctctctctcaccccagcctcgcttccgcctcccctccccctcttcccttccctttccttccccactcccacttcccaaccctggatccaaatcccaagctatcccagaaccgaaaccgaggcgcgcaagcaattattagctggctagctaggagcgtacagtagctccgagatcatgaagcgcgagtaccaagacgccggcgggagcggcggcgacatgggctcctccaaggacaagatgatggcggcggcggcgggggagcaggatgaggaggtggacgagctgctggccgcgctcgggtacaaggtgcgctcgtccgacatggcggacgtcgcgcagaagctggagcagctcgagatggccatgggaatgggcggcgtgggcggcgccgccacagccgtcgatgacgggtttgtctcgcacctcgccacggacacagtgcactacaacccctccaacctgtcgtcctgggtcgagagcatgctgtccgagctcaacgcgccgccgccgccgctccccacagcgccgccggctccgcggctcgcgtccacctcgtccaccgtcacgggtggcgccgccgccggtggagggtactttgatctcccgcccgccgtcgactcgtccagcagcacgtacgctctgaagccgatcccctcgccggtggcggcgtcggcggacccgtcaacggactcgacgcgggagcccaagcggatgcgaactggcggcggcagcacgtcgtcttcctcttcctcgtcgtcttccctggacggcggccgcaccaggagctccgtggtcgaggcggccccgccggcgacgcaagcgtccgcggcggccaacgcgcccgcggtgccggtggtggtggtggacacgcaggaggccgggatccggctcgtgcacgcgctgctggcctgcgcggaggccgtgcagcaggagaacttcaccgccgcggaggcgctggtcaagcaaatccccatgctggcatcgtcgcagggcggcgccatgcgcaaggtcgccgcctacttcggcgaggcgctcgctcgccgcgtgtaccgcttccgccctgccccggacagctccctcctcgacgctgccttcgccgacctcctccacgcgcacttctacgagtcctgcccctacctcaagttcgcccacttcaccgcgaaccaggccatcctggaggcgttcgccggctgccgccgcgtccatgtcgtcgatttcggcatcaagcaggggatgcagtggccggctcttctccaggctcttgccctccgtcctggcggccccccatcgttccgcctcaccggcgtcggcccgccgcagccggacgagaccgacgctttgcagcaggttggttggaagcttgcccagttcgcgcacacaatccgcgtcgacttccagtaccgcggcctcgtcgccgccacgctcgctgaccttgagccgttcatgctgcaaccggacggcgaggatacggatgacgagcccgaggtgatcgccgtcaactcggtgttcgagctgcatcggctgctggcgcagcccggcgccctggagaaggtcctgggcacggtgcgcgcagtgcggccgaggatcgtgaccgtggtcgagcaggaggccaaccacaactccgtctcattcctggaccgcttcacggagtcgctgcactactactccaccatgttcgattccctcgagggcgccggctccggccaatccgccgatgccgccccggccgcggccggcggcacggaccaggtcatgtccgaggtgtacctcggccggcagatctgtaacgtcgtggcgtgcgagggtgcggagcgcaccgagcggcacgagacgctggggcagtggcgcaaccgcctgggcggcgccgggttcgagcccgtccacctgggctccaatgcctacaagcaggcgagcacgctactggcgctgttcgccggcggcgacgggtacagggtggaggaaaaggacgggtgcctgaccctggggtggcacacgcgcccgctcatcgccacctcggcatggcgcgtcgccgcgccgtgatcgggcgggtgcggttttggacgctgatcaggatgcacgtccccgggcatggcgcaccccctccacccagctcgccggcacagctgaagctagacgtcaacgaacgctgaattgcagtgagcgaccgggccacggttcactccggcgtgatgagatggacacttggactccgaccggaccggcctgtgttcgttcttgttcccgatcccccctctcatcacctccctccaatccgtagcctattgttatgtttaaatgtctattattatgtgtaattcctccaatcgctcatatcccaataaggacgaaccggatttgtttagctcg

SEQ ID NO: 201 - protein, 621 aa, Panicum virgatum
  misc_feature (1)..(621): Ceres Clone ID no. 1776298
  misc_feature (239)..(617): Pfam Name: GRAS Pfam Description: GRAS family transcription factor
  misc_feature (35)..(111): Pfam Name: DELLA Pfam Description: Transcriptional regulator DELLA protein N terminal
  misc_feature (1)..(621): Bit score of 1181.5 for HMM based on sequences of Figure 3
  misc_feature (1)..(621): Functional Homolog Of SEQ ID NO. 188
  misc_feature (1)..(621): in Figure 3
MKREYQDAGGSGGDMGSSKDKMMAAAAGEQDEEVDELLAALGYKVRSSDMADVAQKLEQLEMAMGMGGVGGAATAVDDGFVSHLATDTVHYNPSNLSSWVESMLSELNAPPPPLPTAPPAPRLASTSSTVTGGAAAGGGYFDLPPAVDSSSSTYALKPIPSPVAASADPSTDSTREPKRMRTGGGSTSSSSSSSSSLDGGRTRSSVVEAAPPATQASAAANAPAVPVVVVDTQEAGIRLVHALLACAEAVQQENFTAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPDGEDTDDEPEVIAVNSVFELHRLLAQPGALEKVLGTVRAVRPRIVTVVEQEANHNSVSFLDRFTESLHYYSTMFDSLEGAGSGQSADAAPAAAGGTDQVMSEVYLGRQICNVVACEGAERTERHETLGQWRNRLGGAGFEPVHLGSNAYKQASTLLALFAGGDGYRVEEKDGCLTLGWHTRPLIATSAWRVAAP

SEQ ID NO: 202 - protein, 618 aa, Hordeum vulgare
  misc_feature (1)..(618): Public GI ID no. 75161835
  misc_feature (230)..(614): Pfam Name: GRAS Pfam Description: GRAS family transcription factor
  misc_feature (39)..(110): Pfam Name: DELLA Pfam Description: Transcriptional regulator DELLA protein N terminal
  misc_feature (1)..(618): Bit score of 1145.1 for HMM based on sequences of Figure 3
  misc_feature (1)..(618): Functional Homolog Of SEQ ID NO. 188
  misc_feature (1)..(618): in Figure 3
MKREYQDGGGSGGGGDEMGSSRDKMMVSSSEAGEGEEVDELLAALGYKVRASDMADVAQKLEQLEMAMGMGGPAPDDGFATHLATDTVHYNPTDLSSWVESMLSELNAPPPPLPPAPPQLNASTSSTVTGGGGYFDLPPSVDSSSSTYALRPIISPPVAPADLSADSVRDPKRMRTGGSSTSSSSSSSSSLGGGAARSSVVEAAPPVAAAAAAPALPVVVVDTQEAGIRLVHALLACAEAVQQENLSAAEALVKQIPLLAASQGGAMRKVAAYFGEALARRVFRFRPQPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVFEMHRLLAQPGALEKVLGTVRAVRPRIVTVVEQEANHNSGSFLDRFTESLHYYSTMFDSLEGGSSGGPSEVSSGGAAPAAAAGTDQVMSEVYLGRQICNVVACEGTERTERHETLGQWRNRLGNAGFETVHLGSNAYKQASTLLALFAGGDGYKVEEKEGCLTLGWHTRPLIATSAWRLAAP

SEQ ID NO: 203 - protein, 590 aa, Lactuca sativa
  misc_feature (1)..(590): Public GI ID no. 204022232
  misc_feature (216)..(588): Pfam Name: GRAS Pfam Description: GRAS family transcription factor
  misc_feature (62)..(129): Pfam Name: DELLA Pfam Description: Transcriptional regulator DELLA protein N terminal
  misc_feature (1)..(590): Bit score of 906.1 for HMM based on sequences of Figure 3
  misc_feature (1)..(590): Functional Homolog Of SEQ ID NO. 188
MKPNHPQKPIIACPNSTSTSTSIRGGASSATTGPALNSFTSDVTGKGKNMWDEFDDQDAGVDELLAVLGYKVKSSDMVDVAQKIEHLEGVLGNDDGLSQIASDSVHYNPSDLSSWLESMICELNPTTEAPMIDDSFMNTSSASAVAAAPSPGLTSVFVDDLQAIPGNAIYPPAKKAKHSPSSSSGATSASSSYNSKPNPNSNSVVLVDSQENGIRLVHTLMACAEAIQQENLSLAENLVKQAGMLAVSQAGAMRKVATYFAEALARRIYRLAPQTTQDSPAFQDLLQMHFYETCPYLKFAHFTANQAILEAFAGKKKVHVIDFSMKQGMQWPALMQALALRPGGPPTFRLTGIGPPSGDNTDHLQEVGWKLAQLADTIHVEFEYRGFVAESLADLEPAMLDLRDDEVVAVNSVFELHQLLARPGAVEKVLSAVKEMKPVILTVVEQEANHNGLVFLERFTESLHYYSTLFDSLESSGTGGGGVEGGAISPASNQDKIMSEVYLGKQICNVVACEGPDRVERHETLTQWKARLDSSGFEAVHLGSNAFKQASMLLALFAGGDGYRVEENNGCLMLGWHTRPLITTSAWKLR

SEQ ID NO: 204 - protein, 538 aa, Wilkesia gymnoxiphium
  misc_feature (1)..(538): Public GI ID no. 20257432
  misc_feature (189)..(538): Pfam Name: GRAS Pfam Description: GRAS family transcription factor
  misc_feature (24)..(90): Pfam Name: DELLA Pfam Description: Transcriptional regulator DELLA protein N terminal
  misc_feature (1)..(538): Bit score of 761.5 for HMM based on sequences of Figure 3
  misc_feature (1)..(538): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESLVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNTDALQQVGWKLAQLADTISVEFEFRGFVANSIADIDANMLDIRPSETEVVAVNSVFEVHRFLARPGDVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 205 - protein, 590 aa, Vitis vinifera
  misc_feature (1)..(590): Public GI ID no. 225424291
  misc_feature (214)..(575): Pfam Name: GRAS Pfam Description: GRAS family transcription factor
  misc_feature (35)..(106): Pfam Name: DELLA Pfam Description: Transcriptional regulator DELLA protein N terminal
  misc_feature (1)..(590): Bit score of 955.8 for HMM based on sequences of Figure 3
  misc_feature (1)..(590): Functional Homolog Of SEQ ID NO. 188
MKREYHHPHHPTCSTSPTGKGKMWDADPQQDAGMDELLAVLGYNVKASDMAEVAQKLEQLEEVIVNAQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRLKPTTSATANSVSSVIGGWGVPTESARPVVLVDSQETGIRLVHTLMACAEAVQQENLKLAEALVKQIGFLAVSQAGAMRKVATYFAEGLARRIYRLYPDKPLDSSFSDILQMHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLALFAGGDGYRVEENNGCLMLGWHTRPLIATSAWQLANKPALPSSTPASN

SEQ ID NO: 206 - protein, 548 aa, Carlquistia muirii
  misc_feature (1)..(548): Public GI ID no. 20257447
  misc_feature (199)..(548): Pfam Name: GRAS Pfam Description: GRAS family transcription factor
  misc_feature (24)..(91): Pfam Name: DELLA Pfam Description: Transcriptional regulator DELLA protein N terminal
  misc_feature (1)..(548): Bit score of 864.7 for HMM based on sequences of Figure 3
  misc_feature (1)..(548): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLLVLNDDNNNNNTADDSDHIFLPGNSLTTMIDFSNSTETVVHGKQRSKLHEDDPYDLRAIAGGAIYRSESESSIRGNGNPNGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNAIETSCYEILQMHFYETCPYLKFAHFTANQAILEAFAGATRVHVIDFSLNQGMQWPALMQALALRSGGPPAFRLTGIGPPQPDNSDVLQQVGWKLAQLADTIGVEFEFRGFVANSIADIDVSMLDIRAPDTEVVAVNSVFEVHRLLARPGAVEKVLSSITGMKPKIVTLVEQESNHNGAVFMERFNEALHYYSTMFDSLESSALTLPNNQDDLVMSEVYLGRQICNVVACEGTERVERHETLTQWRVRMNLAGFEPVHLGSNAFKQASMLLALFAGGDGYKVEENDGCLM

SEQ ID NO: 207 - protein, 618 aa, Saccharum hybrid
  misc_feature (1)..(618): Public GI ID no. 70797560
  misc_feature (1)..(618): Saccharum hybrid cultivar Co 419
  misc_feature (236)..(614): Pfam Name: GRAS Pfam Description: GRAS family transcription factor
  misc_feature (37)..(113): Pfam Name: DELLA Pfam Description: Transcriptional regulator DELLA protein N terminal
  misc_feature (1)..(618): Bit score of 1164.2 for HMM based on sequences of Figure 3
  misc_feature (1)..(618): Functional Homolog Of SEQ ID NO. 188
  misc_feature (1)..(618): in Figure 3
MKREYQDAGGSGGDMGSSKDKMMVAAAGAGEQEEEMDEMLAAVGYKVRSSDMADVAQKLEQLEMAMGMGGVGGAGATADDGFISHLATDTVHYNPSDLSSWVESMLSELNAPPPPAPRLASTSSTVTSGAAAGAGYFDLPPAVDSSSSTYALKPIPSPVVASADPSSTDSTREPKRMRTGGGSTSSSSSSSSSMDGGRTRSSVVEAAPPATQASAAANGPAVPVVVMDTPEAGIRLVHALLACAEAVQQENFSAADALVKQIPMLASSQGGAMRKVAAYFGEALARRVYRFRPTPDSSLLDAAVADFLHAHFYESCPYLKFAHFTANQAILEAFAGCRRVHVVDFGIKQGLQWPALLQALALRPGGPPSFRLTGVGPPQHDETDALQQVGWKLAQFAHTIRVDFQYRGLVAATLADLEPFMLQPEGDDKDEEPEVIAVNSVFELHRLLAQPGALEKVLGTVRAVRPRIVTVVEQEANHNSGTFLDRFTESLHYYSTMFDSLEGAGSGQSTDASPAAAGGTDQVMSEVYLGRQICNVVACEGAERTERHETLGQWRNRLGGSGFEPVHLGSNAYKQASTLLALFNGGDGYKVEEKDGCLTLGWHTRPLIATSAWRLAAP

SEQ ID NO: 208 - protein, 511 aa, Arabidopsis thaliana
  misc_feature (1)..(511): Public GI ID no. 15219630
  misc_feature (152)..(506): Pfam Name: GRAS Pfam Description: GRAS family transcription factor
  misc_feature (32)..(98): Pfam Name: DELLA Pfam Description: Transcriptional regulator DELLA protein N terminal
  misc_feature (1)..(511): Bit score of 699.6 for HMM based on sequences of Figure 3
  misc_feature (1)..(511): Functional Homolog Of SEQ ID NO. 188
MKREHNHRESSAGEGGSSSMTTVIKEEAAGVDELLVVLGYKVRSSDMADVAHKLEQLEMVLGDGISNLSDETVHYNPSDLSGWVESMLSDLDPTRIQEKPDSEYDLRAIPGSAVYPRDEHVTRRSKRTRIESELSSTRSVVVLDSQETGVRLVHALLACAEAVQQNNLKLADALVKHVGLLASSQAGAMRKVATYFAEGLARRIYRIYPRDDVALSSFSDTLQIHFYESCPYLKFAHFTANQAILEVFATAEKVHVIDLGLNHGLQWPALIQALALRPNGPPDFRLTGIGYSLTDIQEVGWKLGQLASTIGVNFEFKSIALNNLSDLKPEMLDIRPGLESVAVNSVFELHRLLAHPGSIDKFLSTIKSIRPDIMTVVEQEANHNGTVFLDRFTESLHYYSSLFDSLEGPPSQDRVMSELFLGRQILNLVACEGEDRVERHETLNQWRNRFGLGGFKPVSIGSNAYKQASMLLALYAGADGYNVEENEGCLLLGWQTRPLIATSAWRINRVE

SEQ ID NO: 209 - protein, 519 aa, Vitis vinifera
  misc_feature (1)..(519): Public GI ID no. 225457448
  misc_feature (147)..(518): Pfam Name: GRAS Pfam Description: GRAS family transcription factor
  misc_feature (13)..(88): Pfam Name: DELLA Pfam Description: Transcriptional regulator DELLA protein N terminal
  misc_feature (1)..(519): Bit score of 284.9 for HMM based on sequences of Figure 3
  misc_feature (1)..(519): Functional Homolog Of SEQ ID NO. 188
MASDLLSEERSDEVSGLDTSLSAQAYYSRSYLPIFQNGSATNWFHYSDEARNHKRLKRTQSIAESIGSNSSLYSGGKSYSNSSSSFINRSSSTNSLNSLPRLHFRDHIWTYTQRYLAAEAVEEAAAAMISAAEGEVEEDGSGDGMRLVQLLIACAEAVACRDKTHASSLLSELRANALVFGSSFQRVASCFVQGLADRLSLVQPLGAVGFIAPSINPLDTAWEKKEEALRLVYEICPHIKFGHFVANASILEAFEGENFAHVVDLGMTLGLAHGQQWRQLIHSLANRAGRPPRRLRITGVGLCVDRFKIIGEELEAYAQDLDINLEFSAVESNLENLRPEDIKREDGEALVVNSILQLHCVVKESRGALNSVLQKINELSPKVLVLVEQDSSHNGPFFLGRFMEALHYYSAIFDSLEAMLPKYDTRRAKIEQFYFGEEIKNIVSCEGPARVERHERVDQWRRRMSRAGFQAAPIKMMAQAKQWLGKVKACEGYNIMEEKGCLVLGWKSKPIVAASCWKC

SEQ ID NO: 210 - DNA, 1824 bp, Populus trichocarpa
  misc_feature (1)..(1824): Ceres Annot ID no. 1502385
  misc_feature (1)..(1824): Encodes the peptide sequence at SEQ ID NO. 211
atgaagagagatcatcaagaaaccattggtggtggtattggaaacagagctgaatcttcttcttcatcaatggaaactgggaaaggaaaatcatgggttgaagatgatcaagatgcgggtggcatggatgaattacttgctgttttgggttacaaaattaagtcttcagatatggctgatgtagctcaaaagcttgaacaactagagatggttttgggttctgaagatggaatttctcatcttgcttctgatactgttcactataacccttcagatctctctggttgggttcaaagtatgctttctgaattcaacaatctaccttctactgatcttgattcatctattcttctttccaataatcgagattcactccttggacaaccttccactatcacccccttagatttccccagtaattctcaatctaaagtattcgctgacgactctgaatatgatctcagagcaatccctggagttgctgcctatccacaacaagaactcgataagagtaacgacaggaagcgaatgaagctcactccaattgggtctaatattgcgccggcaccatctgtgaattccttacaatctcccactgcatcttccacttcttcttcatctccgcaagcaatggcagtttcaggtactttgtcagagcccacaagacctgtagtcctggttgactcacaggaaactggagtccgtcttgtccacacacttttggcttgtgcagaggcaattcagcaagaaaatcttaaacttgctgatgcccttgttaagcatataggactacttgcagcatctcaaactggggctatgagaaaagttgcaacttacttcgctgaagctttagctcgtcgaatttacaagattttccctcaagattactgtctcgattcttcatgttcagatactttagagatgcatttctacgaaacttgcccttatctcaagttcgcacatttcactgccaatcaagccattcttgaagctttcgcgaatgcaagtcgagtccacgttatcgattttggtttaaaacagggaatgcaatggccggcgttaatgcaagctcttgcattaaggcctggtggtccgccagcgtttcggttgacggggatcgggccgccgcagcctgataacacagatgctttgcagcaagtggggtggaagctggcacaattggctcaaactattggagtagaattcgagtttcgcggattcgtagcaaactctctggcggatcttgatgcggagatgcttggcctcctccctccagaggtggaggcagtggctgttaactcggtttttgagctgcatcgcttgttgggtcggccgggtggcatcgacaaggttctcgagtctatcaaggccatgagacctaaaattgtgacgattgttgaacaagaagcaaaccacaacggtccggtttttctagaccggttcacagaggccttacattattactcgagtttgtttgactctctcgaagggtccggtttgactccaccgagtcaggacctggttatgtccgagctgtacttagggaggcatatttgtaatgtggtggcatgcgaaggggctgaccgagttgagcgacacgagacgttggctcagtggagaactcggtttgattcggctgggtttgacccggttcatcttgggtcgaatgcctttaaacaagctagtatgttgttggccctctttgccggtggtgacgggtatagggtggaggagaataatggctgtctcatgcttgggtggcatacaaggccactaattgccacctcggcgtggcagctcgccgctggtgattcacaacaatga

SEQ ID NO: 211 - protein, 607 aa, Populus trichocarpa
  misc_feature (1)..(607): Ceres Annot ID no. 1502385
  misc_feature (236)..(599): Pfam Name: GRAS Pfam Description: GRAS family transcription factor
  misc_feature (43)..(111): Pfam Name: DELLA Pfam Description: Transcriptional regulator DELLA protein N terminal
  misc_feature (1)..(607): Bit score of 1086.2 for HMM based on sequences of Figure 3
  misc_feature (1)..(607): Functional Homolog Of SEQ ID NO. 188
MKRDHQETIGGGIGNRAESSSSSMETGKGKSWVEDDQDAGGMDELLAVLGYKIKSSDMADVAQKLEQLEMVLGSEDGISHLASDTVHYNPSDLSGWVQSMLSEFNNLPSTDLDSSILLSNNRDSLLGQPSTITPLDFPSNSQSKVFADDSEYDLRAIPGVAAYPQQELDKSNDRKRMKLTPIGSNIAPAPSVNSLQSPTASSTSSSSPQAMAVSGTLSEPTRPVVLVDSQETGVRLVHTLLACAEAIQQENLKLADALVKHIGLLAASQTGAMRKVATYFAEALARRIYKIFPQDYCLDSSCSDTLEMHFYETCPYLKFAHFTANQAILEAFANASRVHVIDFGLKQGMQWPALMQALALRPGGPPAFRLTGIGPPQPDNTDALQQVGWKLAQLAQTIGVEFEFRGFVANSLADLDAEMLGLLPPEVEAVAVNSVFELHRLLGRPGGIDKVLESIKAMRPKIVTIVEQEANHNGPVFLDRFTEALHYYSSLFDSLEGSGLTPPSQDLVMSELYLGRHICNVVACEGADRVERHETLAQWRTRFDSAGFDPVHLGSNAFKQASMLLALFAGGDGYRVEENNGCLMLGWHTRPLIATSAWQLAAGDSQQ

SEQ ID NO: 212 - DNA, 2321 bp, Panicum virgatum
  misc_feature (1)..(2321): Ceres Clone ID no. 1809677
  misc_feature (1)..(2321): Encodes the peptide sequence at SEQ ID NO. 213
gtctcctcactcccctccacatcactcaccgcccgccagccgcgaagccgtcactctggtgaccgcgtcgcaggcgcagcgcacgccaccgagtcacccacccaccgacccatggccatgggcggcgcgttccccttccagtggcccgcggacccggggctcgacgccgccgccgccctgcccccgctgcccaccgcggtgcccgacgccggggtggcgtcgtactacgcgggcgcggccggcatgcacgcagcgcaggtggagctgcccgatctcgccgcggcgctggcggcgatgcggcgggaggaggaggaggccgcgggcatccgcctcgtgcacctcctcatgagctgcgccggcgccgtcgaggccggggaccacgcgggagcctccgcgcacctgaccgacgcgcacgccgcgctcgccgccgtctcgccggcctccggcatcggccgcgtcgccgtccacttcacagccgcgctgtcccggcggctgttccccccaacgccgtcgcctccgccgccgctcgccgccgcggacgccgaccacggcttcctctaccaccacttctacgaggcggggccctacctcaagttcgcgcacttcacggccaaccaggccatcctggaggccgtccagggctgcaggcacgtccacatcatcgacttcaacctcatgcaggggctccagtggcccgcgctgatccaggccctcgcgctccgccccggcgggccgccgttcctccgcctcaccggcattggcccgccctccccgccggggcgcgacgacctccgcgacgtcggcgtccgcctcgccgacctggcgcgctccgtgcgcgtccacttctccttccgcggcgtggccgccaaccgcctggacgaggtccgcccctggatgctgcaggtgtcgcagggcgaggccatcgccgtgaactcggtgctccagctccaccgcctggtcggcgacccgcccgcggccgacggccgggcgcccatcgacgcggtcctcgactgcgtggcctccctgcggcccagggtgttcacggtggtggagcaggaggccgaccacaacaagccggggttcctggaccggttcacggaggcgctcttctactactcggcggtgttcgactccctggacgcggcgagcggcggcgcgggcgacgcggcggcggaggcgtacctggagcgcgagatctgcgacatcgtgtgcggcgagggcgcggagcggcgggagcggcacgagccgctgcggcggtggcgggagcggctggggcgcgcggggctgggcggcgtgccgctgggggcgaacgcgctgcggcaggcgaggatgctggtggggctcttctccggggagggccactgcgtggaggaggccgaggggtgcctgacgctggggtggcacgggcggccgctcttctcggcgtccgcgtggcgggcggaggagggcaatcagagcgacagcaacgcggccggcagcagcggcagcgaggagagcaatatcagctgcagctgctaggactggagcagctactgtaaattggtaagagtagcggggtttactgtaaaatcgcggcggcggcgcggtcccggggggaatgaaatcgatcgtaaatggcaggcagactgaagactcaatctgaaatgacatgaaattctgttagcaatgccgtcatggttgaataaacggcgccgagactgaaagcgtccctggaaaatgccattgcaatagtagaaaagaaactacactggcgtggcattgacgtattgtgctggttggactggatggatggaatcaaggcacacccgtggcacttctcactcagccgctgatagatagctgctgacaacagcaaccgcttctgatcctcatctacagactactggcgctttcaacaaccaaccaccccctgacgatggaggctgttgggctgatctgatgaatagtattcggctggtagaatgaacagtattatgtgagaagaaataagccgaaacaagtcgagacaagccgagaaccgatctgccgaacaggctcgatgtctctgtaaaatggaaatctaaaaccactagccgcggatgcgcctctggcgcagcggtaactcccactgatgggagcgtactggcgggagttcgagcccccgtccgcacctgggtatcgaggctgtgtgcgtgtgtgctgggtgtgtgtgcgtgtgtggtggtgtgcgttctcggtatggcgcgttccgagactattcggacagcctcgtctgcgttgagttcgatcagtgtaggcgtccagaaatcttacatgactccccagagctcttggatgctttc

SEQ ID NO: 213 - protein, 468 aa, Panicum virgatum
  misc_feature (1)..(468): Ceres Clone ID no. 1809677
  misc_feature (74)..(442): Pfam Name: GRAS Pfam Description: GRAS family transcription factor
  misc_feature (2)..(73): Pfam Name: DELLA Pfam Description: Transcriptional regulator DELLA protein N terminal
  misc_feature (1)..(468): Bit score of 465.0 for HMM based on sequences of Figure 3
  misc_feature (1)..(468): Functional Homolog Of SEQ ID NO. 188
MAMGGAFPFQWPADPGLDAAAALPPLPTAVPDAGVASYYAGAAGMHAAQVELPDLAAALAAMRREEEEAAGIRLVHLLMSCAGAVEAGDHAGASAHLTDAHAALAAVSPASGIGRVAVHFTAALSRRLFPPTPSPPPPLAAADADHGFLYHHFYEAGPYLKFAHFTANQAILEAVQGCRHVHIIDFNLMQGLQWPALIQALALRPGGPPFLRLTGIGPPSPPGRDDLRDVGVRLADLARSVRVHFSFRGVAANRLDEVRPWMLQVSQGEAIAVNSVLQLHRLVGDPPAADGRAPIDAVLDCVASLRPRVFTVVEQEADHNKPGFLDRFTEALFYYSAVFDSLDAASGGAGDAAAEAYLEREICDIVCGEGAERRERHEPLRRWRERLGRAGLGGVPLGANALRQARMLVGLFSGEGHCVEEAEGCLTLGWHGRPLFSASAWRAEEGNQSDSNAAGSSGSEESNISCSC

SEQ ID NO: 214 - DNA, 1884 bp, Sorghum bicolor
  misc_feature (1)..(1884): Ceres Annot ID no. 8633163
  misc_feature (1)..(1884): Encodes the peptide sequence at SEQ ID NO. 215
atgaagcgcgagtaccaagacgccggcgggagcggcggcgacatgggctcctccaaggacaagatgatggtggcggcggcgggggcaggggagcaggaggaggagctggacgagatgctggcctcgctcggctacaaggtgcgttcgtcggatatggcggacgtcgcacagaagctggagcagctcgagatggccatggggatgggcggcgttggcggcgccggcgctaccgctgatgacggcttcatctcgcacctcgccacggacaccgtgcactacaatccctccgacctgtcgtcctggctcgagagcatgctgtccgagctcaacgcgcccccaccgccgctcccgcccgcgacgacgccgccggccccgaggctcgcgtccacctcgtccaccgtcacaagtggcgccgccgccggtgctggctacttcgatctcccgcccgccgtcgactcgtccagcagcacctacgccctgaagccgatcccctcgccggtggcggtggcgtcggccgacccgtcctccacggactccacgcgggagcccaagcggatgcggactggcggcggcagcacgtcgtcttcgtcttcctcgtcgtcatccatggatggcggccgcactaggagctccgtggtcgaggctgccccgcccgcgacgcaggcgcccgcggcggccaacgggcccgccgtgccggtggtggtgatggacacgcaggaggctgggatccggctcgtgcacgcgctgctggcgtgcgcggaggccgtgcagcaggagaacttctctgcggcggacgcgctggtcaagcagatccccatgctggcctcgtcgcagggcggtgccatgcgcaaggtcgccgcctacttcggcgaggcgcttgcccgccgcgtgtatcgcttccgcccgacgccggacacctccctcctcgacgccgccgtcgccgacttcctgcacgcgcacttctacgagtcctgcccctacctcaagttcgcccacttcaccgcgaaccaggcaatcctcgaggctttcgccggctgccgccgcgtccacgtcgtcgacttcggcatcaagcaggggctgcagtggccggctcttctccaggccctcgccctccgtcctggcggccccccatcgttccgactcaccggcgtcggcccaccgcagcacgacgagaccgacgccttgcaacaggtgggctggaaacttgctcagttcgcgcacaccatccgcgtcgacttccagtatcgtggcctcgtcgccgccacgctcgctgacctggagccgttcatgctgcaaccggagggggacgacaaggatgaggagcccgaggtgatcgccgtcaactcagtgttcgagctgcatcggctgctcgctcagcccggcgccctggagaaggtcctgggcacggtgcgcgcggtgcggccgaggatcgtgaccgtggtcgagcaggaggccaaccacaactccggcacattccttgaccgcttcacggagtccctgcactactactccaccatgttcgattctctcgagggcgccggctccggccaatccaccgatgcctctccggccgcggccggcggcacggaccaggtcatgtccgaggtgtacctgggccggcagatctgcaacgttgtggcatgtgagggcgcggagcgcacggagcgccacgagacgctgagtcagtggcgcggccgcctcgtcggctccgggttcgagcccgtgcacctgggctccaatgcctacaagcaggcgagcacgctgctggcactcttcaacggcggcgacgggtacagggtggaggagaaggacgggtgcctgaccctggggtggcatacgcgcccgctcatcgccacctcggcatggcgcctcgccgctccgtga

SEQ ID NO: 215 - protein, 627 aa, Sorghum bicolor
  misc_feature (1)..(627): Ceres Annot ID no. 8633163
  misc_feature (1)..(627): Public GI ID no. 242038399
  misc_feature (245)..(623): Pfam Name: GRAS Pfam Description: GRAS family transcription factor
  misc_feature (37)..(113): Pfam Name: DELLA Pfam Description: Transcriptional regulator DELLA protein N terminal
  misc_feature (1)..(627): Bit score of 1165.9 for HMM based on sequences of Figure 3
  misc_feature (1)..(627): Functional Homolog Of SEQ ID NO. 188
  misc_feature (1)..(627): in Figure 3
MKREYQDAGGSGGDMGSSKDKMMVAAAGAGEQEEELDEMLASLGYKVRSSDMADVAQKLEQLEMAMGMGGVGGAGATADDGFISHLATDTVHYNPSDLSSWLESMLSELNAPPPPLPPATTPPAPRLASTSSTVTSGAAAGAGYFDLPPAVDSSSSTYALKPIPSPVAVASADPSSTDSTREPKRMRTGGGSTSSSSSSSSSMDGGRTRSSVVEAAPPATQAPAAANGPAVPVVVMDTQEAGIRLVHALLACAEAVQQENFSAADALVKQIPMLASSQGGAMRKVAAYFGEALARRVYRFRPTPDTSLLDAAVADFLHAHFYESCPYLKFAHFTANQAILEAFAGCRRVHVVDFGIKQGLQWPALLQALALRPGGPPSFRLTGVGPPQHDETDALQQVGWKLAQFAHTIRVDFQYRGLVAATLADLEPFMLQPEGDDKDEEPEVIAVNSVFELHRLLAQPGALEKVLGTVRAVRPRIVTVVEQEANHNSGTFLDRFTESLHYYSTMFDSLEGAGSGQSTDASPAAAGGTDQVMSEVYLGRQICNVVACEGAERTERHETLSQWRGRLVGSGFEPVHLGSNAYKQASTLLALFNGGDGYRVEEKDGCLTLGWHTRPLIATSAWRLAAP

SEQ ID NO: 216 - protein, 652 aa, Selaginella moellendorffii
  misc_feature (1)..(652): Public GI ID no. 302786358
  misc_feature (245)..(649): Pfam Name: GRAS Pfam Description: GRAS family transcription factor
  misc_feature (37)..(112): Pfam Name: DELLA Pfam Description: Transcriptional regulator DELLA protein N terminal
  misc_feature (1)..(652): Bit score of 303.7 for HMM based on sequences of Figure 3
  misc_feature (1)..(652): Functional Homolog Of SEQ ID NO. 188
MLDGYSKEGVIVGQNWGSSSSIIIDDTEEEDRSNQQAKRSAMVDMIQAAHQAHPSQLGGSYSGFFHPGSGGGGGDEFDRRSAAYIPSQWRESPNPFLKYYHANSREGEGTEKPLDDLASSKIHVFQREIEISSATSAPDLKILFPKSSSLVRHHERKKKKRLVDGDDDLDLLSLRPPNSAHSDTTTTTTTATNASSSPDRESSIIAHNHSLFHKPAQVELPRPNHIDLPRLDPPGHHQALGLELLNVLLECAQAVHRQDLDSATALLAQLKHGASVYGDSMQRLTAHFAEGLATRILHHRHSATAVQLLPPAKLDLLHSLILHRPAANPAAADDHLAAFTALYKVSPFFKLAHFTANQAIVEAVAGRARVHVIDLDILQGFQWPSFIQALASRSGGPPSLLTLTGIGSSAESLRDTGNRLSSFAAMFGVPFRFQPLVVGSLEELDLGARIEPRTGHGEVEDMEEEEDEEEEAVAVNAVFQLHRLLNAPRESRKLERFLAGLRRIRPAAVTVVEQEAAHNAPDFIARFVEALHYYAAVFDSLDASLPQRDEERVRIEQVMFAAQIKNIVSCEGAERIERHEKMGFWAGKMGECGFAQAPMSSHSVSQAKLLLQLCPCDGYRVVESPCEGWPVGSISLGWQQRLLLTASTWGCA

SEQ ID NO: 217 - protein, 569 aa, Lactuca sativa
  misc_feature (1)..(569): Public GI ID no. 204022230
  misc_feature (195)..(567): Pfam Name: GRAS Pfam Description: GRAS family transcription factor
  misc_feature (54)..(120): Pfam Name: DELLA Pfam Description: Transcriptional regulator DELLA protein N terminal
  misc_feature (1)..(569): Bit score of 793.2 for HMM based on sequences of Figure 3
  misc_feature (1)..(569): Functional Homolog Of SEQ ID NO. 188
MKREYPQQDYTFFNGGSSTSASASTAAASGSGFSDVTGKSKMWDEVEEQDAGVDELLAVLGYKVKSSDMADVAQKIEHLEGVLGNDDGLSQLASDSVHYNPSDLSSWLESMICELNPTNQPTVIDDSFVNNTSSVTPSAVDSSSVFVDDLQRIPGNAIYPPAKKQKPSSPSTGASSSYNPNPIVLVDTQENGIRLVHTLMACAEAVQQDDLKLAETLVKQAGILAVSQAGAMRKVATYFAEALARRIYRLYPKTPQDSPAFQDLLQMHFYETCPYLKFAHFTANQAILEAFAGKKKVHVIDFSMKQGMQWPALMQALALRPGGPPTFRLTGIGPPSGDNTDHLQEVGWKLAQLADTIHVEFEYRGFLAESLADLEPSMLDLREDEVVAVNSVFELHQLLARPGAVEKVLSAVKEMKPEILTVVEQEANHNGPVFLERFTESLHYYSTLFDSLESSGNGGGVVEGGGIPAASNQDKIMSEVYLGKQICNVVACEGPDRVERHQTLSQWKTRFESGGFEVVHLGSNAYKQASMLLALFAGGDGYRVEENNGCLMLGWHTRPLITTSAWKLR

SEQ ID NO: 218 - DNA, 1809 bp, Populus trichocarpa
  misc_feature (1)..(1809): Ceres Annot ID no. 1463794
  misc_feature (1)..(1809): Encodes the peptide sequence at SEQ ID NO. 219
atgaaaagagaacactcaaatctccatcctcaacaacttactaacccatcttctcttgccgcaggtgggtattctcttactagcaccggtactatgacttctaataacgggaaagctaagacgtgggaggaagagaagggacgtcaagcagatggcgggatggatgaacttttagctgttttgggttacaaagtaaggtcatcagacatggctgaggttgcccaaaaacttgaacagcttgaagaagtgatgggtcatgcacaagaagatggtctttcccatcttgcatctgattctgttcactacaatccttccgatctgtctacttggcttgaaagcatgctttctgagttaaacccaaatcaccatttcgatctttctgctgattctttacttgctcctgctgaatcttccaccgtcacttccatcgatttcaccgaccgcaaacatcatcagcaaccaaagctgttcgaggaatcttcatcatcggaatatgatctgaaagtcataccaggtaaggctgtcttctctccaacccagatcgactctagagaatctaaacgcttaaaaacagacctatatcaaacatcctcttcgccatcctcgtcctccacaactctcggttctcttgtggcttcgaccgagtcaactcgcccggtagtcctggttgactcacaagaaaacggtgttcgtctcgtccatctcttaatggcctgtgccgaagcagtccaagaaaacaacttaaatctggcggaagccctcgtcaaacaaatcggctttttagctgtttctcaggccggagccatgcgtaaggtagccacctacttcgccgaggcattagctcggagaatctacaaattataccctcaaaattcaaccgaccactctctctcagatattcttcagatacacttctatgagacctgcccttatctcaagtttgctcacttcacggccaatcaagcgattcttgaagcctttgaagggaaaaaacgggttcatgttattgatttttctatgaaccaaggcatgcagtggcccgctttaatgcaagctcttgctctcagacctggtggcccacctgctttgcggttaaccggcattggaccaccggctcatgataacacggaccagcttcaagaggtggggtggaagttggctcagttggcagagactattcatgtggaattcgagtatagaggttttgtggctaacagtttggctgatctcgatgcttccatgctagaactcagacctactgagttcgagtctgtggctgttaactcgatctttgagtttcataaattgttggctataccgggagctatgaaaaaggttttatcagttgtgaaacaaatgaaaccggagattgttactgtcgttgagcaagaagcgaaccataacggtccagttttcttggacaggttcaccgagtcactgcactattactcgactctgtttgactcgttggagggatcagtgagtacccaggataaggtaatgtcagaggtgtacttggcgaagcagatttgcaatgttgtggcttgtgaaggacctagccgagttgagaggcacgagaccctgactcagtggcgaactcggctgagttcggctgggtttgctccggttcatcttggttcaaacgcgtttaagcaagccagcatgttgttggccctgtttgctggtggagacgggtatagagtggaagagaataatgggtgtttgatgttgggttggcatactcgcccactcattgccacctcggcttggcgggtcaacaaccaccacccagttggcggtgctgcttaa

SEQ ID NO: 219 - protein, 602 aa, Populus trichocarpa
  misc_feature (1)..(602): Ceres Annot ID no. 1463794
  misc_feature (232)..(591): Pfam Name: GRAS Pfam Description: GRAS family transcription factor
  misc_feature (55)..(124): Pfam Name: DELLA Pfam Description: Transcriptional regulator DELLA protein N terminal
  misc_feature (1)..(602): Bit score of 975.5 for HMM based on sequences of Figure 3
  misc_feature (1)..(602): Functional Homolog Of SEQ ID NO. 188
MKREHSNLHPQQLTNPSSLAAGGYSLTSTGTMTSNNGKAKTWEEEKGRQADGGMDELLAVLGYKVRSSDMAEVAQKLEQLEEVMGHAQEDGLSHLASDSVHYNPSDLSTWLESMLSELNPNHHFDLSADSLLAPAESSTVTSIDFTDRKHHQQPKLFEESSSSEYDLKVIPGKAVFSPTQIDSRESKRLKTDLYQTSSSPSSSSTTLGSLVASTESTRPVVLVDSQENGVRLVHLLMACAEAVQENNLNLAEALVKQIGFLAVSQAGAMRKVATYFAEALARRIYKLYPQNSTDHSLSDILQIHFYETCPYLKFAHFTANQAILEAFEGKKRVHVIDFSMNQGMQWPALMQALALRPGGPPALRLTGIGPPAHDNTDQLQEVGWKLAQLAETIHVEFEYRGFVANSLADLDASMLELRPTEFESVAVNSIFEFHKLLAIPGAMKKVLSVVKQMKPEIVTVVEQEANHNGPVFLDRFTESLHYYSTLFDSLEGSVSTQDKVMSEVYLAKQICNVVACEGPSRVERHETLTQWRTRLSSAGFAPVHLGSNAFKQASMLLALFAGGDGYRVEENNGCLMLGWHTRPLIATSAWRVNNHHPVGGAA

SEQ ID NO: 220 - protein, 636 aa, Malus x domestica
  misc_feature (1)..(636): Public GI ID no. 296804670
  misc_feature (268)..(627): Pfam Name: GRAS Pfam Description: GRAS family transcription factor
  misc_feature (52)..(121): Pfam Name: DELLA Pfam Description: Transcriptional regulator DELLA protein N terminal
  misc_feature (1)..(636): Bit score of 929.6 for HMM based on sequences of Figure 3
  misc_feature (1)..(636): Functional Homolog Of SEQ ID NO. 188
MKREHQTHQLNQYPPPQYPDPSMASTSAGGGGGFCKAKMWEDESQRIDGGMDELLAVLGYKVRSSDMAEVAQKLEQLEEFMGCAQEDGLSQLASDTVHYNPADLSTWLESMISEINLPPPNFDPLTGGAVAGMHANQQQVQLVDDPFLARGESSITTVDFPDQRKSKSISTSPPQTVFEDCNSSSSYYDFKSIPGNAVFTQTRLDSPSRELKRLKSSSGSSPSELLFNRPAASSLPQPQQPISLPATVESSPTRPALIVDSQENGVRLVHGLMACAEAVQQNNFNLAKALVTQIGYLAGSQAGAMRKVATFFAEALAQRIFRVYLQSPIDHSFSDMLQMHFYETCPYLKFAHFTANQAILESLQGKTRVHVIDFSMNQGMQWPALMQALALRPGGPPAFRLTGIGPPASDNSDHLQEVGWKLAQLAETIHVEFEYRGFVANSLADLDASMLELGPSEVESVAVNSVFELHKLLARPGAIEKVLSVVKQMKPEIVTVVEQEANHNGPVFMDRFNESLHYYSTLFDSLEGSANSRDKVMSEVYLGKQICNVVACEGVDRVERHETLAQWRARFGSADFVPVHLGSNAFKQASMLLALFAGGDGYRVEENDGCMMLAWHTRPLIATSAWKPSSNSVIAH

SEQ ID NO: 221 - protein, 625 aa, Oryza sativa
  misc_feature (1)..(625): Public GI ID no. 59800349
  misc_feature (1)..(625): Oryza sativa Indica Group
  misc_feature (241)..(621): Pfam Name: GRAS Pfam Description: GRAS family transcription factor
  misc_feature (39)..(113): Pfam Name: DELLA Pfam Description: Transcriptional regulator DELLA protein N terminal
  misc_feature (1)..(625): Bit score of 1168.8 for HMM based on sequences of Figure 3
  misc_feature (1)..(625): Functional Homolog Of SEQ ID NO. 188
  misc_feature (1)..(625): in Figure 3
MKREYQEAGGSSGGGSSADMGSCKDKVMAGAAGEEEDVDELLAALGYKVRSSDMADVAQKLEQLEMAMGMAGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPAMQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 222 - protein, 579 aa, Cucurbita maxima
  misc_feature (1)..(579): Public GI ID no. 75121087
  misc_feature (211)..(570): Pfam Name: GRAS Pfam Description: GRAS family transcription factor
  misc_feature (46)..(117): Pfam Name: DELLA Pfam Description: Transcriptional regulator DELLA protein N terminal
  misc_feature (1)..(579): Bit score of 902.6 for HMM based on sequences of Figure 3
  misc_feature (1)..(579): Functional Homolog Of SEQ ID NO. 188
MKREHHYLHPRPEPPSVATGSNRESYLNTGKAKLWEEEVQLDGGMDELLAVLGYKVKSSDMAEVAQKLEQLEEAMCQVQDTGLSHLAFDTVHYNPSDLSTWVESMLTELHPPPTSHLDDSSFLAPAESSTIANVDYEPQLQTSSRIFEESSSSDYDLKAITDSAIYSPRESKRLKASESDTDVFSTSAIGASNFATRPVVLVDSQENGIQLVHALMVCAEAVQQNNLNLAEALVKRIDYLAVSQAGAMRKVATFFAEALARRIYRLCPENPLDRSVLDMLQMHFYESCPYLKFAHFTANQAILEAFEGKKRVHVIDFSMNQGIQWPALIQALALRPSGPPTFRLTGIGPPAPDNSDYLQDVGWKLVKFAETLHVEFEYRGFVANSLADLDASMLELRPSEVESVVVNSVFELHQLLARPGAIEKVLSVVKQMKPEIVTVVEQEANHNGPVFVERFTESLHYYSTLFDSLECSPNSQDKMMSEMYLGKQICNVVACEGADRVERHETLTQWRTRLSSAGFDPIHLGSNAFKQASILLALFGSGEGYRVEENEGSLMLGWHTRPLIATSAWKPGNNPVVAH

SEQ ID NO: 223 - DNA, 1935 bp, Arabidopsis thaliana
  misc_feature (1)..(1935): Ceres Annot ID no. 870628
  misc_feature (1)..(1935): Encodes the peptide sequence at SEQ ID NO. 224
atcagtctcttaactcaccatcacaagaacaagaaagatgaagagaggatacggagaaacatgggatccgccaccaaaaccactaccagcttctcgttccggagaaggtccttcaatggcggataagaagaaggctgatgatgacaacaacaacagcaacatggatgatgagcttcttgctgttcttggctacaaggttcgatcttctgagatggctgaagtagcacagaagcttgaacaacttgagatggtcttgtctaatgatgatgttggttctactgtcttaaacgactctgttcattataacccatctgatctctctaactgggtcgagagcatgctttctgagctgaacaacccggcttcttcggatcttgacacgacccgaagttgtgtggatagatccgaatacgatctcagagcaattccgggtctttctgcgtttccaaaggaagaggaagtctttgacgaggaagctagcagcaagaggatccgactcggatcgtggtgcgaatcgtcggacgagtcaactcggtccgtggtgctcgttgactctcaggagaccggagttagacttgtccacgcactagtggcgtgcgctgaggcgattcaccaggagaatctcaacttagctgacgcgctggtgaaacgcgtgggaacactcgcgggttctcaagctggagctatgggaaaagtcgctacgtattttgctcaagccttggctcgtcgtatttaccgtgattacacggcggagacggacgtttgcgcggcggtgaacccatctttcgaagaggttttggagatgcacttttacgagtcttgcccttacctgaagttcgctcatttcacggcgaaccaagcgattctagaagctgttacgacggcgcgtagagttcacgtcattgatttagggcttaatcaagggatgcaatggcctgctttaatgcaagctttagctctccgacccggtggacctccgtcgtttcgtctcaccggaatcggaccaccgcagacggagaattcagattcgcttcaacagttaggttggaaattagctcaattcgctcagaacatgggcgttgaattcgaattcaaaggcttagccgctgagagtttatcggatcttgaacccgaaatgttcgaaacccgacccgaatctgaaaccttagtggttaattcggtatttgagctccaccggttattagcccgatccggttcaatcgaaaagcttctcaatacggttaaagctattaaaccgagtatcgtaacggtggttgagcaagaagcgaaccacaacggaatcgtcttcctcgataggttcaacgaagcgcttcattactactcgagcttgtttgactcgctcgaagacagttatagtttaccgagtcaagaccgagttatgtcagaagtgtacttagggagacagatactcaacgttgttgcggcggaagggtccgatcgggtcgagcggcacgagacggctgcacagtggaggattcggatgaaatccgctgggtttgacccgattcatctcggatctagcgcgtttaaacaagcgagtatgcttttatcgctttacgctaccggagatggatacagagttgaagaaaatgacggatgtttaatgatagggtggcagacgcgaccactcatcacaacctcggcgtggaaactcgcctgagtcgcggcggtagagatgactcgcctgaaaccgggaaaaacaataaatgttttaaaaaattaggaaaagagaccgtaactttagttatgtttttactttttaacccgaagtttttgtgtgtttaacctttttgcctaaatgtttacaactttatctttttggaccttgtgcgtatctttgagagttaagagaacgagtaaaaaatcttgtatcgtagatcgagctaagtagttttcaataaatggaaggataac

SEQ ID NO: 224 - protein, 547 aa, Arabidopsis thaliana
  misc_feature (1)..(547): Ceres Annot ID no. 870628
  misc_feature (180)..(545): Pfam Name: GRAS Pfam Description: GRAS family transcription factor
  misc_feature (44)..(112): Pfam Name: DELLA Pfam Description: Transcriptional regulator DELLA protein N terminal
  misc_feature (1)..(547): Bit score of 733.6 for HMM based on sequences of Figure 3
  misc_feature (1)..(547): Functional Homolog Of SEQ ID NO. 188
MKRGYGETWDPPPKPLPASRSGEGPSMADKKKADDDNNNSNMDDELLAVLGYKVRSSEMAEVAQKLEQLEMVLSNDDVGSTVLNDSVHYNPSDLSNWVESMLSELNNPASSDLDTTRSCVDRSEYDLRAIPGLSAFPKEEEVFDEEASSKRIRLGSWCESSDESTRSVVLVDSQETGVRLVHALVACAEAIHQENLNLADALVKRVGTLAGSQAGAMGKVATYFAQALARRIYRDYTAETDVCAAVNPSFEEVLEMHFYESCPYLKFAHFTANQAILEAVTTARRVHVIDLGLNQGMQWPALMQALALRPGGPPSFRLTGIGPPQTENSDSLQQLGWKLAQFAQNMGVEFEFKGLAAESLSDLEPEMFETRPESETLVVNSVFELHRLLARSGSIEKLLNTVKAIKPSIVTVVEQEANHNGIVFLDRFNEALHYYSSLFDSLEDSYSLPSQDRVMSEVYLGRQILNVVAAEGSDRVERHETAAQWRIRMKSAGFDPIHLGSSAFKQASMLLSLYATGDGYRVEENDGCLMIGWQTRPLITTSAWKLA

SEQ ID NO: 225 - protein, 636 aa, Malus xiaojinensis
  misc_feature (1)..(636): Public GI ID no. 219964535
  misc_feature (268)..(627): Pfam Name: GRAS Pfam Description: GRAS family transcription factor
  misc_feature (52)..(121): Pfam Name: DELLA Pfam Description: Transcriptional regulator DELLA protein N terminal
  misc_feature (1)..(636): Bit score of 926.3 for HMM based on sequences of Figure 3
  misc_feature (1)..(636): Functional Homolog Of SEQ ID NO. 188
MKREHQTHQLNQYPPPQYPDPSMASTSAGGGGGFCKAKMWKDESQRIDGGMDELLAVLGYKVRSSDMAEVAQKLEQLEEFMGCAQEDGLSQLASDAVHYNPADLSTWLESMISEINLPPPNFDPLTGGAVAGVQPNQQQVQLVDDPFLARGESSITTVDFPDQRKSKSISTSPPQTVFDDCNSSSSYYDFKSIPGNSVFTQTHLDSPSRELKRLKSSSGSSPSELLFNRPAASSLPQPQQPISLPATVESSPTRPALIVDSQENGVRLVHGLMACAEAVQQNNLNLAKALVTQIGYLAGSQAGAMRKVATFFAEALAQRIFRVYLQSPIDHSFSDMLQMHFYETCPYLKFAHFTANQAILESLQGKSRVHVIDFSMNQGMQWPALMQALALRPGGPPAFRLTGIGPPASDNSDHLQEVGWKLAQLAETIHVEFEYRGFVANSLADLDASMLELGPSEVESVAVNSVFELHKLLARPGAIEKVLSVVKQMKPEIVTVVEQEANHNGPVFMDRFNESLHYYSTLFDSLEGSANSRDKVMSEVYLGKQICNVVACEGVDRVERHETLAQWRARFGSADFVPVHLGSNAFKQASMLLALFAGGDGYRVEENDGCMMLAWHTRPLIATSAWKPSSNSVIAH

SEQ ID NO: 226 - protein, 592 aa, Pisum sativum
  misc_feature (1)..(592): Public GI ID no. 113171199
  misc_feature (219)..(585): Pfam Name: GRAS Pfam Description: GRAS family transcription factor
  misc_feature (61)..(131): Pfam Name: DELLA Pfam Description: Transcriptional regulator DELLA protein N terminal
  misc_feature (1)..(592): Bit score of 961.0 for HMM based on sequences of Figure 3
  misc_feature (1)..(592): Functional Homolog Of SEQ ID NO. 188
MKRDRQETSGGGVSSNNNNSDNIISNNFVSVRGECSSMQNNNNNGKQSLWSEEKENSGGMDELLAALGYKVRSSDMLDVAQKLEQLEMVMGSAQEEGINHLASDTVHYDPTDLYSWVQTMLTELNPSTDSQINDPLDSSSSIFNDNSQYDLSVIPGMAAYPPQSHNQNSESEGSNSNKRLKTWGSETESEDIFLPALSPPAETTRPVVLVDSQETGVRLIHTMMACADAIQRDDIKIADRLVKNIGILASSQTGAMGKVASYFAQALYRRICRVSPDETLDSSLSDALHMHFYESSPYLKFAHFTANQAILEAFAGAGSVHVIDFGLKQGMQWPALMQALALRPGGPPTFRLTGIGPPQTGNTDALQQVGWKLAQLAQTIGVQFEFRGFVCNSLADLDPNMLEIRPGEAVAVNSVFELHTMLARPGSIDKVLNTVKKINPKIVTIVEQEANHNGPVFMDRFTEALHYYSSLFDSLEGSSNSNPAGSGSSSQDLLMSELYLGRQICNVVAYEGVDRVERHETLSQWRSRMGSAGFDPVHLGSNAFKQASTLLALFAGGDGYRVEENNGCLMLGWHTRSLIATSAWKLPLSESK

SEQ ID NO: 227 - DNA, 2060 bp, Gossypium hirsutum
  misc_feature (1)..(2060): Ceres Clone ID no. 1945971
  misc_feature (1)..(2060): Encodes the peptide sequence at SEQ ID NO. 228
atcctagtcccctcctgtttcctccattagacctcccaccaattttctccactttcttccatattctcccccttttctaaattccaacaaaaatcaaaaaccccaatttaacaccccccttgttttttcttttccatgaccaaattctagcaaaaaaaaaatgaagagagatcatcaagaaatttctgggagtggttcaaaaccagctgagagttcatccattaaagggaaattatgggaaaaagatccagatgctggtggcatggacaacgagttattagctgttttgggttacaaagttcggtcatcagatatggcggatgtagctcaaaaattggaaatgttggagaaagttatgggtactgctcaagaagatgggatttcacagcttggtgatactgttcattttaatccttcagatctatccggttgggttcaaaatttgttgatcgagttcaacggtccaacaacaaccccagatcccaatttcaacgatgattctgagtacgatcttagagcaataccaggggtcgccgcttacccaccggtgaaatcggatccgggtctagaaaatacccggaaacgagctaaaactgagtcctcctcatcatcatcttcaacaactactcgtcctgttgtgttgattgactcacaagaagctggggttcgactcgttcatacattaatggcttgtgctgaagctgttcaacaagataatcttaaactagctgatgcattagtgaaacatattgggttacttgcttcatcacaaactggtgctatgagaaaagttgctacttattttgctgaagctttagctcgaagaatttatagaattttcccaccagattcacttgatccatcatataatgataagttacaaattcccttctatgagacttgtccttatttgaaatttgctcattttacagccaatcaagccatattggaagctttttcaatggctagtagagttcatgttattgattttgggctaaaacaaggtatgcaatggccagctttaatgcaagcacttgcattaagacccggtggaccaccggcgtttcgattgaccggaattggaccgcctcaaccggataatactgatgcgttgcaacaagtggggtggaagctagctcaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccmagattgtcacggttgttgaacaagaagcgaatcacaacggtccggttttcttagaccgttttactgaagctctccattattattctacccttttcgactcgttggaaggttcaggggtggcgccagcgagtcaagacctggctatgtccgagttatacttaggaagacagatttgtaacgtggttgcttgtgaagggatggaccgagttgaacgacacgagccgctgactcagtggagaactcggatggaaacggccgggtttagccctgttcatttgggttccaatgcttataaacaagctagtatgttgttggccctcttcgccagcggcgatgggtatagagtggaggagaataatgggtgtttaatgcttgggtggcatacaaggccacttatcgccacctcggcttggcgactcgctggtactgagtcaggtagtgagttaactcaggagctgagttgagaaaaagtaaaaaacctgttgaaaagaataagtggggtctatcttttaactgagttgcagaatgtacgagtgaatgaaaaaaatgagggtaaattaaaaaccagtccaagtgtgtaattctagtttttctttgtctatttttttcccactttttagtattgtttttagtttcttttagggtagattttttttttaatggggagcctttgtaattttcaaggttggatctaatgtgaaggcatatctttttatt

SEQ ID NO: 228 - protein, 548 aa, Gossypium hirsutum
  misc_feature (1)..(548): Ceres Clone ID no. 1945971
  misc_feature (171)..(533): Pfam Name: GRAS Pfam Description: GRAS family transcription factor
  misc_feature (37)..(106): Pfam Name: DELLA Pfam Description: Transcriptional regulator DELLA protein N terminal
  misc_feature (1)..(548): Bit score of 827.5 for HMM based on sequences of Figure 3
  misc_feature (1)..(548): Functional Homolog Of SEQ ID NO. 188
  misc_feature (395)..(395): Xaa is any aa, unknown, or other
MKRDHQEISGSGSKPAESSSIKGKLWEKDPDAGGMDNELLAVLGYKVRSSDMADVAQKLEMLEKVMGTAQEDGISQLGDTVHFNPSDLSGWVQNLLIEFNGPTTTPDPNFNDDSEYDLRAIPGVAAYPPVKSDPGLENTRKRAKTESSSSSSSTTTRPVVLIDSQEAGVRLVHTLMACAEAVQQDNLKLADALVKHIGLLASSQTGAMRKVATYFAEALARRIYRIFPPDSLDPSYNDKLQIPFYETCPYLKFAHFTANQAILEAFSMASRVHVIDFGLKQGMQWPALMQALALRPGGPPAFRLTGIGPPQPDNTDALQQVGWKLAQLAERIGIEFEFRGFVANSLADLEPEMLDIRPPEIEVVAVNAVFELHPLLARPGGIEKVVSSIKAMKPXIVTVVEQEANHNGPVFLDRFTEALHYYSTLFDSLEGSGVAPASQDLAMSELYLGRQICNVVACEGMDRVERHEPLTQWRTRMETAGFSPVHLGSNAYKQASMLLALFASGDGYRVEENNGCLMLGWHTRPLIATSAWRLAGTESGSELTQELS

SEQ ID NO: 229 - DNA, 2016 bp, Populus trichocarpa
  misc_feature (1)..(2016): Ceres Annot ID no. 1440830
  misc_feature (1)..(2016): Encodes the peptide sequence at SEQ ID NO. 230
atggggtctctcaagagcgagaactcatgcaacaagttgcaaccaacttctcctaatgagtcatcatcagtcactgaatctaaaaaaactactcagtcttttgaatttgaacaaaatagcctaaccccaacaagcctaaacttacctgcagtcaaatttgagttggatggagatgttgaagtccagtcacctgatagttccatgtgggagagctttttcactgataattttgactctgacttcatgatctcatctccagtgaggaacttgccatcgccacaaacttcaagctacaatcacaattatgctcatgcaatgcaagggcagagtctttcaggctgctctcctcctagatatttatctcagcttggagctgctttcagtagtatccacaaagggaagggacagagtccactccatagaatgtgtaactctccaaataatcaattcatgcaagttgagagcctttctttaccaggtattgaggacttcttggatgattttcaaagagatgggtacggagaaggataccaacaaccacctaagatgtcaggcagcagtggaagttcaacacaattgtttgatatgtcaaccacagttcctgcaatgttggattgcttgactatacagaatccctccaggttttgttctggatcggtgagtgaaacatcatcaggctcaccaatgacacaggagagcgatatttttcagatgggttctattggaattgcaccatcatcacagaaactattacaggaaaaccagcagcagccgcagccgctgccacaaccaacaacacaaccacagcctccaccaacaacccaatccctgcaacagcaaccacagagtcttaaccataccttgatggtatctcttcctattggctctgagcaggaacaagatagtggcctccaactactgaacctcctccttgcttgtgctgaggcggtatccaatgaagactacatgctagctagaagatatctccaccacctgaatagagtcgtcagcccccttggcgactccatgcaaagagttgcgtcctgtttcactgaggccctaagtgctaggctagctgcaacccttacaactaaacctagtacctcctcttcaaaagccttctctcctttccctccaaactccatggaaattctcaaaatttaccaaatactttaccaagcttgcccttacgtaaagtttgctcatttcactgctaatcaagcaatttttgaggcctttgaaactgaagaacgtgttcatgttattgacctagacattcttcaaggctatcaatggccagctttcatgcaagccctagcagctagacctggtggcgctccattcctccgaataactggagttggatcctctatggagaatgttagagagaccggtcggtgcttgacagaactagctcattctcttcatgttccatttgagtaccacccagttgctgaagaactcgtagaccttaaaccacacatgttcaatagaagggttggtgaggctcttgctgttaactctgttaaccggctccaccgtgtccccgggaattgcctggggaacctattagcaatgatccgtgaccaagcgccaaacatagtaacagtagttgagcaagaagcaagccataacggaccatacttcttaggtaggttcctggaggcattgcactattattcagcaatttttgactctttggattcaacttttccgccagattcttcacaaagggcaaaagtggagcagtacatatttgctccagagataaggaacatagtggcatgtgagggagcagagaggtttgagagacatgagaggcttgagaaatggaggaagctaatggaagggaaagggtttaagggggtgccactgagtgcaaatgcagtgactcagtccaagatcttattgggcttgtattcctgtgatgggtacagattgacagaggacaaaggctgcttgctcttggggtggcaagatagagccatacttgctgcttctgcatggagatgctga

SEQ ID NO: 230 - protein, 590 aa, Populus trichocarpa
  misc_feature (1)..(590): Ceres Annot ID no. 1440830
  misc_feature (226)..(589): Pfam Name: GRAS Pfam Description: GRAS family transcription factor
  misc_feature (56)..(124): Pfam Name: DELLA Pfam Description: Transcriptional regulator DELLA protein N terminal
  misc_feature (1)..(590): Bit score of 363.6 for HMM based on sequences of Figure 3
  misc_feature (1)..(590): Functional Homolog Of SEQ ID NO. 188
MISSPVRNLPSPQTSSYNHNYAHAMQGQSLSGCSPPRYLSQLGAAFSSIHKGKGQSPLHRMCNSPNNQFMQVESLSLPGIEDFLDDFQRDGYGEGYQQPPKMSGSSGSSTQLFDMSTTVPAMLDCLTIQNPSRFCSGSVSETSSGSPMTQESDIFQMGSIGIAPSSQKLLQENQQQPQPLPQPTTQPQPPPTTQSLQQQPQSLNHTLMVSLPIGSEQEQDSGLQLLNLLLACAEAVSNEDYMLARRYLHHLNRVVSPLGDSMQRVASCFTEALSARLAATLTTKPSTSSSKAFSPFPPNSMEILKIYQILYQACPYVKFAHFTANQAIFEAFETEERVHVIDLDILQGYQWPAFMQALAARPGGAPFLRITGVGSSMENVRETGRCLTELAHSLHVPFEYHPVAEELVDLKPHMFNRRVGEALAVNSVNRLHRVPGNCLGNLLAMIRDQAPNIVTVVEQEASHNGPYFLGRFLEALHYYSAIFDSLDSTFPPDSSQRAKVEQYIFAPEIRNIVACEGAERFERHERLEKWRKLMEGKGFKGVPLSANAVTQSKILLGLYSCDGYRLTEDKGCLLLGWQDRAILAASAWRC

SEQ ID NO: 231 - protein, 616 aa, Gossypium hirsutum
  misc_feature (1)..(616): Public GI ID no. 238821220
  misc_feature (247)..(606): Pfam Name: GRAS Pfam Description: GRAS family transcription factor
  misc_feature (41)..(109): Pfam Name: DELLA Pfam Description: Transcriptional regulator DELLA protein N terminal
  misc_feature (1)..(616): Bit score of 951.6 for HMM based on sequences of Figure 3
  misc_feature (1)..(616): Functional Homolog Of SEQ ID NO. 188
MKRDHNHLQPNPDPSSLRGAPSTGKAKVWDEESAQQDCGMDELLAVLGYKVKTSDMAEVARKLEQLEEVMCNVQDDGISHLASETVHYNPSDLSTWLESMLSELNPPSTFDPFGAAGTAAAALDDSFLVPAESSTLTTLDFDNINRKHQKSGQQIFEEASCSDYDLKAIPGKAIYSQKTQPQTHDSSSSSTPTNVKSEKRFKSTSGPPSPSDIFPPPPPPAAASYGIPTASTRPVVLVDSQENGIRLVHALMACAEAVQQNNLNLAEALVKQIGFLAISQAGAMRKVATYFAEALARRIYRFYPQNPLDHSFSDVLHMHFYETCPYLKFAHFTANQAILEAFEGKKRVHVIDFSMNQGMQWPALMQALALRVGGPPAFRLTGFGPPSHDNSDHLQEVGCKLAQFAKKIHVEFEYRGFVANSLADLDASMLDLRPSEVEAVAVNSVFELHKLLARPGAIDKVFSVVKQMKPELVTIVEQEANHNGPVFLDRFTESLHFYSTLFDSLEGSVSSQDKVMSEVYLGKQICNVVACEGVDRIEGHESLTQWRNRLSTAGFSPVHLGSNAFKQASMLLALFAGGDGYGVEENNGCLMLGWHNRPLIITSAWKLTNKTTAISQ

SEQ ID NO: 232 - protein, 541 aa, Gossypium hirsutum
  misc_feature (1)..(541): Public GI ID no. 257219873
  misc_feature (165)..(530): Pfam Name: GRAS Pfam Description: GRAS family transcription factor
  misc_feature (39)..(109): Pfam Name: DELLA Pfam Description: Transcriptional regulator DELLA protein N terminal
  misc_feature (1)..(541): Bit score of 529.9 for HMM based on sequences of Figure 3
  misc_feature (1)..(541): Functional Homolog Of SEQ ID NO. 188
MVLYDSATLGGSCSGSSSSSSSSKPPPLQQRQQTQQDIDGFLAGAGYRVRSSELRKVAQRLERLETAMVNSPADLSQLASDTIHYNPSDLASWVDSLLSELTQPPTCPSEFIMDPVSNQTVVSDAWTTAEPHMPQVHQNISYEQQSLNNQLTVVPAMEEDSGIRLVHMLMTCAECVQRGDFSLATSCLEDMQGLLTRVNTVCGIGKVAGHFIDALSRRIFQGIGGGSVNGGSAYENELLYHHFYEACPYLKFAHFTANQAILEAFDGHDCVHVVDFNLMHGLQWPALIQALALRPGGPPLLRLTGIGPPSPDGRDSLREIGLRLAELARSVNVRFAFRGVAASRLEDVKPWMLQVNPKESVAVNSIMQLHRLLGSDPNRNSPIETVLSWIRSLNPKIMTVVEQEANHNQPGFLDRFTEALHYYSTMFDSLEACTVQPNKALAEIYIQREIANVVSCEGSARVERHEPLSKWRTRLSGAGFRPLHLGSNAYKQASMLLTLFSAEGYSVEENDGCLTLGWHSRPLIAASAWQAVSDGTADFPA

SEQ ID NO: 233 - protein, 532 aa, Pisum sativum
  misc_feature (1)..(532): Public GI ID no. 113206404
  misc_feature (166)..(522): Pfam Name: GRAS Pfam Description: GRAS family transcription factor
  misc_feature (29)..(101): Pfam Name: DELLA Pfam Description: Transcriptional regulator DELLA protein N terminal
  misc_feature (1)..(532): Bit score of 761.1 for HMM based on sequences of Figure 3
  misc_feature (1)..(532): Functional Homolog Of SEQ ID NO. 188
MKREHNQEHEDASMTGKSEICWEDDGGMDELLAVVGYKVKSSDMAEVAQKLEQLEQAMGNFQDQDEATIAQHLSNDTVHYNPADISNWLQTMLSNFDSQPNPSVSSSSDNDLNAIPGKAIYANTDSQTEESLPSRKRVKRVGSSSSTESTRPVVMVVETQEKGIILVHTLMACAEAVEQNNRPVAEALVKQIGNLAVSQEGAMRKVATYFAIGLARRIYDVFPQHSVSDSLQIHFYETCPYLKFAHFTANQAILEAFQGKSRVHVIDFSINQGMQWPALMQALALRPGGPPAFRLTGIGPPASDNSDHLQQVGWRLAQFAQTIHVQFEYRGFVANSLADLDASMLELRSPETESVAVNSVFELHKLNARPGALEKVFSVIRQIRPEIVTVVEQEANHNGPAFLDRFTESLHYYSTLFDSLESSLVEPQDKAMSEVYLGKQICNVVACEGTDRVERHETLNQWRNRFGSAGFSPVHLGSNAFKQASMLLALFAGGDGYKVEENDGCLMLGWHTRPLIATSAWKLAANSMVVSH

SEQ ID NO: 234 - DNA, 1863 bp, Populus trichocarpa
  misc_feature (1)..(1863): Ceres Annot ID no. 1445496
  misc_feature (1)..(1863): Encodes the peptide sequence at SEQ ID NO. 235
atgaagagagatcatcaagaaaccattggtggtgctgggaattctattggcaacaaagctgaatcttcttcttcgtcaatggcaaccgggaaaggaaaattatgggttgaagatgatcaagatgcaggtggcatggatgaattacttgctgttttgggttacaaaattaagtcttcggaaatggctgatgtagctcaaaaacttgaacaactagagatggttttgggttcagaggatggaatctctcatcttgcttctgatactgtccattacaacccttcagatctctctggttgggttcaaagcatgctttctgagctcaacaatctaccttcttctgatcttgattcatctactcttctttccaataatcaagattcaaatccttccacaatgacctctttagatttccccaataattctcaatctaaagcatttgttgacgactctgaatatgatctcagagcaattcccggcgtagctgcctatcctcaacaagaattcgataagagcaacgataggaagcgaatgaagctcaccctagttgggtccaataccgcgccgacgctagctgtgaattccttacaatcttccaactcgtcttgtactccttcttcttctccacaagcaataatggcagtttcaggtactttatcggagcccacgagacctgtagtcctgattgactcacaggaaactggggtccgtcttgttcatacccttttggcttgtgcagaggcaatacagcaagaaaatcttaaacttgctgatgcccttgttaagcatattggagtacttgcagcatctcaagctggtgctatgagaaaggttgccacgtactttgctgaagctttagctcgtcgaatttacaagattttccctcaagatcactgtcttgattcttcatattcagatacgttagagatgcatttctacgagacttgcccttatctcaaattcgcacattttactgccaatcaagccattcttgaagctttcgctaatgcaagtcgagtccacgttatcgattttggcttaaaacaaggaatgcaatggccggctttaatgcaagcgcttgcattaaggcctggcggtccgccagcatttcggctgacgggaattggaccgccgcagcctgataatactgatgctttgcagcaagtggggtggaagctagcacaattggctcaaactattggggtagaattcgagtttcgtgggttcgtagcaagttctttggcagatcttgaggcggagatgcttgacctccgtcctccagaggtggaggcagtggctgttaactcagtttttgagttgcatcgcttgttggatcggccgggtggcatcgataaggttcttgggtctattaaggccatgaggcctaaaatcgtgacgattgttgagcaagaagcaaaccacaacggtccggtttttctagaccggttcaccgaggccttgcattactattcaagcttgtttgactcactcgaagggtctggggtgactccgacgagtcaggacctggttatgtctgagttgtacttggggaggcagatatgtaatgtggtggcctgcgaaggggctgaccgagttgagcgacatgaaacgttggctcagtggagaactcggttcgattcggctgggttcgacccggttcatctcgggtcgaatgcctttaaacaagctagcatgttgttggccctctttgctgggggtgatgggtatagggtagaggagaacaacgggtgtctcatgcttgggtggcatactaggccactaattgccacctccgcatggcagcttgccgcaggagattcaagattacgagtaaactcagctgagttcgagctaccgagtcaatga

SEQ ID NO: 235 - protein, 620 aa, Populus trichocarpa
  misc_feature (1)..(620): Ceres Annot ID no. 1445496
  misc_feature (237)..(600): Pfam Name: GRAS Pfam Description: GRAS family transcription factor
  misc_feature (46)..(114): Pfam Name: DELLA Pfam Description: Transcriptional regulator DELLA protein N terminal
  misc_feature (1)..(620): Bit score of 1112.6 for HMM based on sequences of Figure 3
  misc_feature (1)..(620): Functional Homolog Of SEQ ID NO. 188
  misc_feature (1)..(620): in Figure 3
MKRDHQETIGGAGNSIGNKAESSSSSMATGKGKLWVEDDQDAGGMDELLAVLGYKIKSSEMADVAQKLEQLEMVLGSEDGISHLASDTVHYNPSDLSGWVQSMLSELNNLPSSDLDSSTLLSNNQDSNPSTMTSLDFPNNSQSKAFVDDSEYDLRAIPGVAAYPQQEFDKSNDRKRMKLTLVGSNTAPTLAVNSLQSSNSSCTPSSSPQAIMAVSGTLSEPTRPVVLIDSQETGVRLVHTLLACAEAIQQENLKLADALVKHIGVLAASQAGAMRKVATYFAEALARRIYKIFPQDHCLDSSYSDTLEMHFYETCPYLKFAHFTANQAILEAFANASRVHVIDFGLKQGMQWPALMQALALRPGGPPAFRLTGIGPPQPDNTDALQQVGWKLAQLAQTIGVEFEFRGFVASSLADLEAEMLDLRPPEVEAVAVNSVFELHRLLDRPGGIDKVLGSIKAMRPKIVTIVEQEANHNGPVFLDRFTEALHYYSSLFDSLEGSGVTPTSQDLVMSELYLGRQICNVVACEGADRVERHETLAQWRTRFDSAGFDPVHLGSNAFKQASMLLALFAGGDGYRVEENNGCLMLGWHTRPLIATSAWQLAAGDSRLRVNSAEFELPSQ

SEQ ID NO: 236 - protein, 580 aa, Vitis vinifera
  misc_feature (1)..(580): Public GI ID no. 147812753
  misc_feature (198)..(561): Pfam Name: GRAS Pfam Description: GRAS family transcription factor
  misc_feature (13)..(82): Pfam Name: DELLA Pfam Description: Transcriptional regulator DELLA protein N terminal
  misc_feature (1)..(580): Bit score of 1075.9 for HMM based on sequences of Figure 3
  misc_feature (1)..(580): Functional Homolog Of SEQ ID NO. 188
  misc_feature (328)..(328): Xaa is any aa, unknown, or other
  misc_feature (571)..(571): Xaa is any aa, unknown, or other
MWDDGQQQDAGMDELLAVLGYNVRSSDMVDVAQKLEQLEMVMGNAQEDGISHLSSGTVHYNPSDLSGWVQSMLTELNPPSSAFASSSQQTPIDDPLLAPSESSTITTLDFSGSRQQSEHQSRIYNDNSDYDLSAIPGVAVYRRPDQQGDGEKSSKRMKTASSSSSSSTQQVQENGLASVAESTRPVVVVDSQETGVRLVHTLMACADAVQQDNMKLADALVKHIGLLAASQAGAMRKVATYFAEALARRIYRIYPQDSLESSYSDILQMHFYEACPYLKFAHFTANQAILEAFAGANRVHVIDFGLKQGMQWPALMQALALRPGGPPXFRLTGIGPPQPDNTDALQQVGWKLAQLAETIGVEFEFRGFVANSLADLEPSMLQIRPPEVEAVAVNSVLELHRLLARPGAIEKVLSSIKAMKPKIVTVVEQEASHNGPVFLDRFTEALHYYSNLFDSLEGCGVSPPSSQDLMMSEIYLGRQICNVVACEGAERVERHETLSQWRSRMGSAGFDPVHLGSNAFKQASMLLALFAGGDGYRVEENNGCLMLGWHTRPLIATSAWQLNSNFNPTSXSASTSAHSQ

SEQ ID NO: 237 - DNA, 2250 bp, Arabidopsis thaliana
  misc_feature (1)..(2250): Ceres Annot ID no. 857982
  misc_feature (1)..(2250): Encodes the peptide sequence at SEQ ID NO. 238
tggtagtagcagtgaaaaacaaaagcaatccaatcccaaacccatttgctcttaagattcttcacatagagaagtcacatgttccttcttcttcttccttcatcatccccaaacacacacaaactaaaaaaaaggcaaaaccctagatccaagatcagacctaatctaatcgaaactcatagctgaaaaatgaagagagatcatcaccaattccaaggtcgattgtccaaccacgggacttcttcttcatcatcatcaatctctaaagataagatgatgatggtgaaaaaagaagaagacggtggaggtaacatggacgacgagcttctcgctgttttaggttacaaagttaggtcatcggagatggcggaggttgctttgaaactcgaacaattagagacgatgatgagtaatgttcaagaagatggtttatctcatctcgcgacggatactgttcattataatccgtcggagctttattcttggcttgataatatgctctctgagcttaatcctcctcctcttccggcgagttctaacggtttagatccggttcttccttcgccggagatttgtggttttccggcttcggattatgaccttaaagtcattcccggaaacgcgatttatcagtttccggcgattgattcttcgtcttcgtcgaataatcagaacaagcgtttgaaatcatgctcgagtcctgattctatggttacatcgacttcgacgggtacgcagattggtggagtcataggaacgacggtgacgacaaccaccacgacaacgacggcggcgggtgagtcaactcgttctgttatcctggttgactcgcaagagaacggtgttcgtttagtccacgcgcttatggcttgtgcagaagcaatccagcagaacaatttgactctagcggaagctcttgtgaagcaaatcggatgcttagctgtgtctcaagccggagctatgagaaaagtggctacttacttcgccgaagctttagcgcggcggatctaccgtctctctccgccgcagaatcagatcgatcattgtctctccgatactcttcagatgcacttttacgagacttgtccttatcttaaattcgctcacttcacggcgaaccaagcgattctcgaagcttttgaaggtaagaagagagtacacgtcattgatttctcgatgaaccaaggtcttcaatggcctgcacttatgcaagctcttgcgcttcgagaaggaggtcctccaactttccggttaaccggaattggtccaccggcgccggataattctgatcatcttcatgaagttggttgtaaattagctcagcttgcggaggcgattcacgtagaattcgaataccgtggattcgttgctaacagcttagccgatctcgatgcttcgatgcttgagcttagaccgagcgatacggaagctgttgcggtgaactctgtttttgagctacataagctcttaggtcgtcccggtgggatagagaaagttctcggcgttgtgaaacagattaaaccggtgattttcacggtggttgagcaagaatcgaaccataacggaccggttttcttagaccggtttactgaatcgttacattattattcgactctgtttgattcgttggaaggagttccgaatagtcaagacaaagtcatgtctgaagtttacttagggaaacagatttgtaatctggtggcttgtgaaggtcctgacagagtcgagagacacgaaacgttgagtcaatggggaaaccggtttggttcgtccggtttagcgccggcacatcttgggtctaacgcgtttaagcaagcgagtatgcttttgtctgtgtttaatagtggccaaggttatcgtgtggaggagagtaatggatgtttgatgttgggttggcacactcgtccactcattaccacctccgcttggaaactctcgacggcggcgtactgagtttgactcgaagcatacgacggtggtggagtcgagtcgagtgaatttgagattgagatcagtggaccggtgatgacatatgttcggaccaagacctaaaccgaactgaatcgaaccgttttgccttttgtttattttatttattttcgttcacttgtttaaaattcttatatatatcgttttggtaggtcatttttaatttatgcctttttgggatcaatttttaataggctgagtttgtatttattaataaattatctttatgaattttaaactaaaactatgttttaatctcat

SEQ ID NO: 238 - protein, 587 aa, Arabidopsis thaliana
  misc_feature (1)..(587): Ceres Annot ID no. 857982
  misc_feature (221)..(581): Pfam Name: GRAS Pfam Description: GRAS family transcription factor
  misc_feature (44)..(111): Pfam Name: DELLA Pfam Description: Transcriptional regulator DELLA protein N terminal
  misc_feature (1)..(587): Bit score of 905.1 for HMM based on sequences of Figure 3
  misc_feature (1)..(587): Functional Homolog Of SEQ ID NO. 188
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAGESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAY

SEQ ID NO: 239 - protein, 567 aa, Ricinus communis
  misc_feature (1)..(567): Public GI ID no. 255586838
  misc_feature (1)..(567): Public GI ID no. 255586838
  misc_feature (200)..(562): Pfam Name: GRAS Pfam Description: GRAS family transcription factor
  misc_feature (40)..(108): Pfam Name: DELLA Pfam Description: Transcriptional regulator DELLA protein N terminal
  misc_feature (1)..(567): Bit score of 1045.3 for HMM based on sequences of Figure 3
  misc_feature (1)..(567): Functional Homolog Of SEQ ID NO. 188
  misc_feature (1)..(567): in Figure 3
MKREHQESKGDSSSSCSAMAKGKLWQEEEEQQQQDGGGMDELLAVLGYKVRSSDMAEVAQKLEQLEMVMGIAQEDGISHLSDTVHYNPSDLSGWVQSMLSELNNPLDTIQNQQDSSSVISFGNSQSGIFNDDSEYDLRAIPGVAAYPPQPESSDSNNNSSSRKRMKTSTLANSDSTIPTNLSEPNRPMVLIDSQETGVRLVHTLLACAEAIQQDNFKLAEALLKHIGLLAASQASSMRKVATYFAEALARRIYKIYPQESLDPSYSDTLEMHFYETCPYLKFAHFTANQAILEAFGTANRVHVIDFGLKQGMQWPALMQALALRPGGPPAFRLTGIGPPQSNNTDALQQVGWKLAQLADTIGVEFEFRGFVANSLADLQPEMLDLRPPDVETVAVNSVFELHRLLARPGGMEKVLSSIKAMKPKIVTVVEQEASHNGPVFLDRFTEALHYYSSLFDSLEGSGLNVPSQDLVMSELYLGRQICNVVACEGAHRVERHESLPHWRTRFESAGFDRVHLGSNAFKQASMLLALFAGGDGYRVEENNGCLMLGWHTRPLIATSAWQLSDSK

SEQ ID NO: 240 - protein, 523 aa, Arabidopsis thaliana
  misc_feature (1)..(523): Public GI ID no. 15237971
  misc_feature (157)..(516): Pfam Name: GRAS Pfam Description: GRAS family transcription factor
  misc_feature (34)..(103): Pfam Name: DELLA Pfam Description: Transcriptional regulator DELLA protein N terminal
  misc_feature (1)..(523): Bit score of 675.5 for HMM based on sequences of Figure 3
  misc_feature (1)..(523): Functional Homolog Of SEQ ID NO. 188
MKRSHQETSVEEEAPSMVEKLENGCGGGGDDNMDEFLAVLGYKVRSSDMADVAQKLEQLEMVLSNDIASSSNAFNDTVHYNPSDLSGWAQSMLSDLNYYPDLDPNRICDLRPITDDDECCSSNSNSNKRIRLGPWCDSVTSESTRSVVLIEETGVRLVQALVACAEAVQLENLSLADALVKRVGLLAASQAGAMGKVATYFAEALARRIYRIHPSAAAIDPSFEEILQMNFYDSCPYLKFAHFTANQAILEAVTTSRVVHVIDLGLNQGMQWPALMQALALRPGGPPSFRLTGVGNPSNREGIQELGWKLAQLAQAIGVEFKFNGLTTERLSDLEPDMFETRTESETLVVNSVFELHPVLSQPGSIEKLLATVKAVKPGLVTVVEQEANHNGDVFLDRFNEALHYYSSLFDSLEDGVVIPSQDRVMSEVYLGRQILNLVATEGSDRIERHETLAQWRKRMGSAGFDPVNLGSDAFKQASLLLALSGGGDGYRVEENDGSLMLAWQTKPLIAASAWKLAAELRR

SEQ ID NO: 241 - protein, 538 aa, Argyroxiphium kauense
  misc_feature (1)..(538): Public GI ID no. 20257436
  misc_feature (189)..(538): Pfam Name: GRAS Pfam Description: GRAS family transcription factor
  misc_feature (24)..(90): Pfam Name: DELLA Pfam Description: Transcriptional regulator DELLA protein N terminal
  misc_feature (1)..(538): Bit score of 756.9 for HMM based on sequences of Figure 3
  misc_feature (1)..(538): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESSVRGNGNGIKRVKSTAVGSVDVQPESPRPVVLVDSQEAGIRLVHTLMACAEAVQHNDLKLADALVKHVGILVALQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSGITKMKPKIVTLVEQESNHNSAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 242 - protein, 500 aa, Vitis vinifera
  misc_feature (1)..(500): Public GI ID no. 225424293
  misc_feature (124)..(485): Pfam Name: GRAS Pfam Description: GRAS family transcription factor
  misc_feature (2)..(73): Pfam Name: DELLA Pfam Description: Transcriptional regulator DELLA protein N terminal
  misc_feature (1)..(500): Bit score of 812.6 for HMM based on sequences of Figure 3
  misc_feature (1)..(500): Functional Homolog Of SEQ ID NO. 188
MDELLAVLGYNVKASDMAEVAQKLEQLEEVIVNAQEDGLSHLASETVHYNPSDLSNWLGSMLSEFNPTPNCALDNPFLPPISPLDYTNCTTANSVSSVIGGWGVPTESARPVVLVDSQETGIRLVHTLMACAEAVQQENLKLAEALVKQIGFLAVSQAGAMRKVATYFAEGLARRIYRLYPDKPLDSSFSDILQMHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLALFAGGDGYRVEENNGCLMLGWHTRPLIATSAWQLANKPALPSSTPASN

SEQ ID NO: 243 - protein, 532 aa, Arabidopsis lyrata
  misc_feature (1)..(532): Public GI ID no. 297844400
  misc_feature (1)..(532): Arabidopsis lyrata subsp. lyrata
  misc_feature (168)..(528): Pfam Name: GRAS Pfam Description: GRAS family transcription factor
  misc_feature (28)..(98): Pfam Name: DELLA Pfam Description: Transcriptional regulator DELLA protein N terminal
  misc_feature (1)..(532): Bit score of 774.1 for HMM based on sequences of Figure 3
  misc_feature (1)..(532): Functional Homolog Of SEQ ID NO. 188
MKRDHPQHHQDKKTMMMMNEEDDANGMDELLAVLGYKVRSSEMADVAQKLEQLEVMMSNVQEDDLSQLATETVHYNPAELYTWLDSMLSDLNPPSSNAEYDLKAIPGDAILNQFAIDSSSSSNQGGGDTNTANKRLKYSNGVVATTTTTAESTRPVVLVDSQENGVRLVHALLACAEAVQKENLTLAEALVKQIGFLAVSQIGAMRKVATYFAEALARRIYRLSPSQSPIDHSLSDTLQMHFYETCPYLKFAHFTANQAILEAFHGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGQPGAIDKVLEVVNQIKPEIFTVVEQESNHNSPVFLDRFTESLHYYSSLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTS

SEQ ID NO: 244 - protein, 573 aa, Brassica rapa
  misc_feature (1)..(573): Public GI ID no. 75104298
  misc_feature (208)..(568): Pfam Name: GRAS Pfam Description: GRAS family transcription factor
  misc_feature (42)..(111): Pfam Name: DELLA Pfam Description: Transcriptional regulator DELLA protein N terminal
  misc_feature (1)..(573): Bit score of 877.9 for HMM based on sequences of Figure 3
  misc_feature (1)..(573): Functional Homolog Of SEQ ID NO. 188
MKRDLHQFQGPNHGTSIAGSSTSSPAVFGKDKMMMVKEEEDDELLGVLGYKVRSSEMAEVALKLEQLETMMGNAQEDGLAHLATDTVHYNPAELYSWLDNMLTELNPPAATTGSNALNPEINNNNNNNSFFTGGDLKAIPGNAVCRRSNQFAFAVDSSSNKRLKPSSSPDSMVTSPSPAGVIGTTVTTVTESTRPLILVDSQDNGVRLVHALMACAEAVQSSNLTLAEALVKQIGFLAVSQAGAMRKVATYFAEALARRIYRLSPPQTQIDHSLSDTLQMHFYETCPYLKFAHFTANQAILEAFEGKKRVHVIDFSMNQGLQWPALMQALALREGGPPSFRLTGIGPPAADNSDHLHEVGCKLAQLAEAIHVEFEYRGFVANSLADLDASMLELRPSETEAVAVNSVFELHKLLGRTGGIEKVFGVVKQIKPVIFTVVEQESNHNGPVFLDRFTESLHYYSTLFDSLEGAPSSQDKVMSEVYLGKQICNLVACEGPDRVERHETLSQWSNRFGSSGFAPAHLGSNAFKQASTLLALFNGGEGYRVEENNGCLMLSWHTRPLITTSAWKLSAVH

SEQ ID NO: 245 - protein, 596 aa, Phaseolus vulgaris
  misc_feature (1)..(596): Public GI ID no. 148189864
  misc_feature (226)..(590): Pfam Name: GRAS Pfam Description: GRAS family transcription factor
  misc_feature (41)..(110): Pfam Name: DELLA Pfam Description: Transcriptional regulator DELLA protein N terminal
  misc_feature (1)..(596): Bit score of 1097.9 for HMM based on sequences of Figure 3
  misc_feature (1)..(596): Functional Homolog Of SEQ ID NO. 188
  misc_feature (1)..(596): in Figure 3
MKRDFQQACAGGPVKGDSSSMPNGKAKMWEEDRHQQGGGMDELLAALGYKVRASDMADVAQKLEQLEMVMGSAQEEGISHLSSYTVHYDPTDLHSWVQSMLSELNPEPTTILDPSSFLIDNPVHSSPILTTTSRVFNDDSEYDLRAIPGIAAYPPQHATSNATTISTTTATSPTTTVATTNTQTVEEIEPGTNKRLKASPIESSESASEPTRPVVLVDSQEAGVRLVHTLMACAEAVQQENLKLADALVKHVGILAASQAGAMRKVATYFAQALARRIYGIFPEETLESSLSDLLHMHFYESCPYLKFAHFTANQAILEAFATAGRVHVIDFGLKQGMQWPALMQALALRPGGPPTFRLTGIGPPQPDNTDALQQVGWKLAQLAQTIGVQFEFRGFVCSSLADLDPNMLEIRPGEAVAVNSVFELHRMLARPGSVDKVMDTVKNLNPKIVTIVEQEANHNGPVFLDRFTEALHYYSSLFDSLEGSSSSTGLGSPSQDLLMSEVYLGKQICNVVAYEGVERVERHETLSQWRGRMGSAGFDPVHLGSNAFKQASMLLALFAGGDGYRVEENNGCLMLGWHTRPLIATSAWKLPSPES

SEQ ID NO: 246 - DNA, 2055 bp, Gossypium hirsutum
  misc_feature (1)..(2055): Ceres Clone ID no. 1884754
  misc_feature (1)..(2055): Encodes the peptide sequence at SEQ ID NO. 247
gtttcctccattagacctcccaccaattttctccactttcttctatattctctcccttttttaacttccaacaaaaaccaaaaaccccaatttaacgcccccaccccttgttttccttttccatgaccaaattctagcaaaaaaaatgaagagagatcatcaagaaatttctgggagtggttcaaatccagctgagagttcatccattaaagggaaattatgggaagaagatccagatgctggtggcatggacgacgagttattagctgttttgggttacaaagttcggtcatcagatatggcggatgtagctcaaaaattggaaatgttggagaaagttatgggtactgctcaagaagatgggatttcacagcttggtgatactgttcattttaatccttcagatctatctggttgggttcaaaatttgttgatcgagttcaacggttcaacaacaacaccagatcccaatttcaacgatgattctgagtacgatcttagagcaataccaggggtcgccgcttacccaccggtgaaatcggatccgggtctagaaaatacccggaaacgagctaaaactgagtcgtcgtcatcatcatcttcaacaactactcgtcctgttgtgttgattgactcacaagaaactggggttcgactcgttcatacattaatggcttgtgctgaagctgttcaacaagataatcttaaactagctgatgcattagtgaaacatattgggttacttgcttcatcacaaactggtgctatgagaaaagttgctacttattttgctgaagcgttagctcgaagaatttatagaattttcccaccagattcacttgatccatcatataatgataagttacaaatgcacttctatgaaacttgtccttatttgaaatttgctcattttacagctaatcaagccatattggaagctttttcaatggctaatagagttcatgttattgattttgggctaaaacaaggtatgcaatggccagctttaatgcaagcacttgcattaagacccggtggaccaccggcgtttcgattgaccggaattggaccacctcaaccggatgatactgatgcgttgcaacaagtggggtggaagctagctgaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccaagattgtcacggttgttgaacaagaagcgaatcacaacggtccggttttcttagaccgttttactgaagctctccattattattctactcttttcgactcgttggaaggttcgggggtggcgccaccgagtcaagacctggctatgtccgagttatacttaggaagacagatttgtaacgtggttgcttgtgaagggatggaccgagttgagcgacacgagccgctgactcagtggagaactcggatggaaacggccgggtttagccctgttcatttgggttccaatgcttataaacaagctagtatgttgttggccctcttcgccagcggcgatgggtatagagtggaggagaataatgggtgtttaatgcttgggtggcatacaaggccacttatcgccacctcggcttggcgactcgctggtactgagtcaggtagtgagttaactcaggagctgagttgagaaaaagtaaaaaacctgttgaaaagaataagtggggtctatattttaactgagttgcagaatgtacgagtgaatgaaaaaaatgagggtaaattaaaaaccagtccaagtgtgtaattctagtttttctttttctatttttttcccactttttagtattgtttttagtttcttttagggtagattttttttctttttttaaatggggagcctttgtaattttcaaggttggatctaatgtgaaggcaaatctttttattatt

SEQ ID NO: 247 - protein, 548 aa, Gossypium hirsutum
  misc_feature (1)..(548): Ceres Clone ID no. 1884754
  misc_feature (171)..(533): Pfam Name: GRAS Pfam Description: GRAS family transcription factor
  misc_feature (37)..(106): Pfam Name: DELLA Pfam Description: Transcriptional regulator DELLA protein N terminal
  misc_feature (1)..(548): Bit score of 834.0 for HMM based on sequences of Figure 3
  misc_feature (1)..(548): Functional Homolog Of SEQ ID NO. 188
MKRDHQEISGSGSNPAESSSIKGKLWEEDPDAGGMDDELLAVLGYKVRSSDMADVAQKLEMLEKVMGTAQEDGISQLGDTVHFNPSDLSGWVQNLLIEFNGSTTTPDPNFNDDSEYDLRAIPGVAAYPPVKSDPGLENTRKRAKTESSSSSSSTTTRPVVLIDSQETGVRLVHTLMACAEAVQQDNLKLADALVKHIGLLASSQTGAMRKVATYFAEALARRIYRIFPPDSLDPSYNDKLQMHFYETCPYLKFAHFTANQAILEAFSMANRVHVIDFGLKQGMQWPALMQALALRPGGPPAFRLTGIGPPQPDDTDALQQVGWKLAELAERIGIEFEFRGFVANSLADLEPEMLDIRPPEIEVVAVNAVFELHPLLARPGGIEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFASGDGYRVEENNGCLMLGWHTRPLIATSAWRLAGTESGSELTQELS

SEQ ID NO: 248 - protein, 530 aa, Artemisia annua
  misc_feature (1)..(530): Public GI ID no. 264688602
  misc_feature (160)..(525): Pfam Name: GRAS Pfam Description: GRAS family transcription factor
  misc_feature (42)..(110): Pfam Name: DELLA Pfam Description: Transcriptional regulator DELLA protein N terminal
  misc_feature (1)..(530): Bit score of 757.5 for HMM based on sequences of Figure 3
  misc_feature (1)..(530): Functional Homolog Of SEQ ID NO. 188
MKRHYPNMLNDIGCSSSSSKPKMLWDGCDGDGDVDDQDAGVDELLAVLGYKVKPSDMADVAQKIEHLEGVFQNDDGLTQLASDSVHYNPSNLSTWLESMITELDPTLSNDLQSIPGNAIYPPSKKLKNLDPGQVQPDPVLEPGRVSPVVLIDTQENGVRLVHTLMACAEAVQQKNLNLAETLVKQAGVLAVSQAGAMRKVATYFAEALARRIYALTPKDSIAFNDVLQSHFYETCPYIKFAHFTANQAILEAFSGAKKVHVIDFSMKQGMQWPALMQALALRPGGPPTFRLTGIGPPSGDEKDHLQEVGWKLAQLAETIQVEFEYRGFLAESLADIEPGMLDIREGELLAVNSCFEMHQLLARAGSVEKVLTAVKDMKPVIFTLVEEEANHNGPVFLDRFTEALHYYSTLFDSLESSGNNGNGEVDGVSNQDKIMSEVYLGKQICNVVACEGVDRVERHMTSGQWKTRFENSGFEPVNLGSNAYKQASMLLALFAGGDGYRVEENNGCLMLGWHTRPLITTSAWKLRCID

SEQ ID NO: 249 - protein, 586 aa, Zea mays
  misc_feature (1)..(586): Public GI ID no. 219886839
  misc_feature (199)..(579): Pfam Name: GRAS Pfam Description: GRAS family transcription factor
  misc_feature (60)..(128): Pfam Name: DELLA Pfam Description: Transcriptional regulator DELLA protein N terminal
  misc_feature (1)..(586): Bit score of 962.8 for HMM based on sequences of Figure 3
  misc_feature (1)..(586): Functional Homolog Of SEQ ID NO. 188
MSCWPRSGTRCVRRIWRTSRRSWSSSRWPWGWAAWAAPALPLMTGSCRTSPRTPCTTIPPTCRPGSRACCPSSTRPQRRSRPRRRPQGSRPHRPPSQVAPPPVLATSISSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAP

SEQ ID NO: 250 - protein, 562 aa, Sinningia speciosa
  misc_feature (1)..(562): Public GI ID no. 222154139
  misc_feature (198)..(560): Pfam Name: GRAS Pfam Description: GRAS family transcription factor
  misc_feature (37)..(109): Pfam Name: DELLA Pfam Description: Transcriptional regulator DELLA protein N terminal
  misc_feature (1)..(562): Bit score of 898.4 for HMM based on sequences of Figure 3
  misc_feature (1)..(562): Functional Homolog Of SEQ ID NO. 188
MKRDHLNQENYSSSSSSGKAKMWCSEPDGQQNDSGVDELFAVLGYNVKSSDMASLAQKIEQLEEVMGSVQQEDGHLSQLASDTVHHNPSDLNSWVESMISGYNPLPEFDSSSSTVVQDQFLESTQMVVDSDFGSDLIAIPGKAVYPRVQTAPPPASPPQKKLKTTPYSGNSGSVSWGLPNESTRQVVLFDSQENGIRLVHTLMACAEAVQQENMKFAEALVKNIGFLAVSQAGAMRKVATYFAEALARRIYKLYPTNPQDSAFTDLLQMHFYETCPYLKFAHFTANQAILEAFAGKNRVHVIDFGMKQGMQWPALLQALALRPGGPPTFRLTGIGPPSYDNTDHLQEVGWKLAQLAETINVEFEYKGFVASSLADLDASMFDIREGETVAVNSIFELHQLLARPGAIDKVLNVVRQMKPEIFTMIEQEANHNGAVFLDRFNESLHYYSTLFDSLESCGGDGVVSDQDKVMSEVYLGRQICNVVASEGVDRVERHETLAQWRTRFGSSGFQPVHLGSNAYKQASTLLVLFAGGDEYRVEENNGCLMLGWRTRPLIATSAWKPS

SEQ ID NO: 251 - protein, 540 aa, Dubautia arborea
  misc_feature (1)..(540): Public GI ID no. 20257420
  misc_feature (191)..(540): Pfam Name: GRAS Pfam Description: GRAS family transcription factor
  misc_feature (24)..(90): Pfam Name: DELLA Pfam Description: Transcriptional regulator DELLA protein N terminal
  misc_feature (1)..(540): Bit score of 874.6 for HMM based on sequences of Figure 3
  misc_feature (1)..(540): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLSVLNENNNTPPSDHIVLSGDSSTTMIDFSNSSEIVVHGKQGSKMHEDDPYDLRAIAGGAIYGGESESSVRGNGNGNGIKRMKSTAVGSVDVQPESPRRVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 252 - protein, 638 aa, Malus hupehensis
  misc_feature (1)..(638): Public GI ID no. 119214959
  misc_feature (267)..(626): Pfam Name: GRAS Pfam Description: GRAS family transcription factor
  misc_feature (51)..(119): Pfam Name: DELLA Pfam Description: Transcriptional regulator DELLA protein N terminal
  misc_feature (1)..(638): Bit score of 941.3 for HMM based on sequences of Figure 3
  misc_feature (1)..(638): Functional Homolog Of SEQ ID NO. 188
MKGEHQIHQLNQYPLPQQHPDPSMASASAGGGFGKAKMWDDESQRMDGGMDELLAVLGYKVRSSDMADVAQKLEQLEEFMGCAQEDGLSQLASDTVHYNPSDLSTWLETMISEINVPPPNFDPLMGGAVAGIQLSQQQVQLVDDPFLAPAESSITTVDFPDHRKSKSMSTSPTQNVFEDCNSSSSYYDFKSIPGNAVFTKTRLDSSSREPKRLKSSSGSSPSDLLFNRPAASSLPQPQQPISLPAPAESSSTRPALLVDSQENGVRLVHGLMACAEAVQQNNFNLAKALVTQIGYLAGSQAGAMRKVATFFAEALAHRIFRVYPQSPIDHSFSDMLQMHFYETCPYLKFAHFTANQAILESLQGKTRVHVIDFSMNQGMQWPALMQALALRPGGPPAFRLTGIGPPASDNSDHLQEVGWKLAQLAETIHVEFEYRGFVANSLADLDASMLELRPSEAESVAVNSVFELHKLLARPGAIEKVLSVVKQMKPEIVTVVEQEANHNGPVFMDRFNESLHYYSTLFDSLEGSANSRDKVMSEVYLGKQICNVVACEGVDRVERHETLAQWRARFGSADFVPVHLGSNAFKQASMLLALFAGGDGYRVEENDGCMMLAWHTRPLIATSAWKPANNSVMAHRVE

SEQ ID NO: 253 - DNA, 2417 bp, Panicum virgatum
  misc_feature (1)..(2417): Ceres Clone ID no. 1862136
  misc_feature (1)..(2417): Encodes the peptide sequence at SEQ ID NO. 254
agccctcgcttccgcctcccctccctccccctcttcttcccttcccttccctttccttccccactcccacttcccaaccctggatccaaatcccaagctatcccagaaccgaaaccgaggcgcgcaagcaattattagctggctagctaggagtgtagctccgagatcatgaagcgcgagtaccaagacgccggcgggagcggcggcgacatgggctcctccaaggacaacatgatggcggcggcgggggagcagaatgaggaggtggacgagctgctggccgcgctcgggtacaaggtgcgctcgtcggacatggcggacgtcgcgcagaagctggagcagctcgagatggccatggggatgggcggcgtgggcggcgccggcgccgccgccgatgacgggttcgtctcgcacctcgtcacggacacagtgcactacaacccctccgacctgtcgtcctgggtcgagaacatgctgtccgagctcaacgcgcccccgcccccgctcccgccggctccgcggctcgcgtccacctcgtccaccgtcacgggtggcgccaccgccggtggagggtactttgatctcccgcccgccgtcgactcgtccagcagcacgtacgcgctcaagccgatcccctcgccggtggcggcgtcggcggacccgtcaacggactcgacgcgggagcccaagcggatgcggactggcggcggcagcacgtcgtcttcctcttcctcgtcgtcatccctggacggcggccgcaccaggagctccgcggtcgaggcggccccgccggcgacgcaagcgtccgcggcggccaacgcgcccgcggtgccggtggtggtggtggacacgcaggaggccgggatccggctcgtgcacgcgctgctggcctgcgcggaggccgtgcagcaggagaacttcaccgcggcggaggcgctggtcaagcaaatccccatgctggcatcgtcgcagggcggcgccatgcgcaaggtcgccgcctacttcggcgaggcgctcgctcgccgcgtgtaccgcttccgccctgccccggacagctccctcctcgacgccgccttcgccgacctcctccacgcgcacttctacgagtcctgcccctacctcaagttcgcccacttcaccgcgaaccaggccatcctcgaggcgttcgccggctgccgccgcgtccatgtcgtcgatttcggcatcaagcaggggatgcagtggccggctcttctccaggccctcgccctccgtcctggcggcccaccgtcgttccgcctcaccggcgtcggcccgccgcagccggacgagaccgacgccttgcagcaggttggttggaagcttgcccagttcgcgcacacaatccgcgtcgacttccagtaccgcggcctcgtcgccgccacgcttgctgaccttgagccgttcatgctgcaaccggacggcgaggacacggatgacgagcctgaggtgatcgccgtgaactcggtgttcgagctgcatcggctgctggcgcagcccggcgccctggagaaggtcctgggcacggtgcgcgcggtgcggccgaggatcgtgaccgtggtcgagcaggaggccaatcacaactccggctcattcctggaccgcttcacggagtcgctgcactactactccaccatgttcgattccctcgagggcgccggcgccggccaatccgccgatgccgctccggccgcggccggcggcacggaccaggtcatgtccgaggtgtaccttggccggcagatctgcaacgtcgtggcgtgcgagggcgcggagcgcacggagcgccacgagacgctggggcagtggcgcaaccgcctgggccgcgcagggttcgagcccgtccacctgggctccaatgcctacaagcaggcgagcacgctgctggcgctgttcgccggcggcgacggatacagggtggaggagaaggacgggtgcctgaccctggggtggcacacgcgcccgctcatctctacctcggcatggcgcctcgccgcgccgtgatcgggcgggtgcggtcttggacgctgatcaggatgcacgtccccgggcatggcgcaccccctccacccagctcgccggcacagctgaagctagacgtcaacgaacgctgaattgcagtgagcgaccgggccacggttcactccggcgtgatgagatggacactttgactccgaccggaccggcctgtgttcgttcttgttcccgatccccccctctcatcacctgcctccaatcggtagcctattgttatgtttaaatgtctattattatgtgtaattcctccaatcgctcatatctcaatctcaataaggacgaaccggatttctttagctcgaatgagaattttgtatacaaggcatcgaatccaaaactgagctatgttcatcaatctgttc

SEQ ID NO: 254 - protein, 617 aa, Panicum virgatum
  misc_feature (1)..(617): Ceres Clone ID no. 1862136
  misc_feature (235)..(613): Pfam Name: GRAS Pfam Description: GRAS family transcription factor
  misc_feature (34)..(110): Pfam Name: DELLA Pfam Description: Transcriptional regulator DELLA protein N terminal
  misc_feature (1)..(617): Bit score of 1168.5 for HMM based on sequences of Figure 3
  misc_feature (1)..(617): Functional Homolog Of SEQ ID NO. 188
MKREYQDAGGSGGDMGSSKDNMMAAAGEQNEEVDELLAALGYKVRSSDMADVAQKLEQLEMAMGMGGVGGAGAAADDGFVSHLVTDTVHYNPSDLSSWVENMLSELNAPPPPLPPAPRLASTSSTVTGGATAGGGYFDLPPAVDSSSSTYALKPIPSPVAASADPSTDSTREPKRMRTGGGSTSSSSSSSSSLDGGRTRSSAVEAAPPATQASAAANAPAVPVVVVDTQEAGIRLVHALLACAEAVQQENFTAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPDGEDTDDEPEVIAVNSVFELHRLLAQPGALEKVLGTVRAVRPRIVTVVEQEANHNSGSFLDRFTESLHYYSTMFDSLEGAGAGQSADAAPAAAGGTDQVMSEVYLGRQICNVVACEGAERTERHETLGQWRNRLGRAGFEPVHLGSNAYKQASTLLALFAGGDGYRVEEKDGCLTLGWHTRPLISTSAWRLAAP

SEQ ID NO: 255 - protein, 579 aa, Brassica rapa
  misc_feature (1)..(579): Public GI ID no. 75104297
  misc_feature (214)..(574): Pfam Name: GRAS Pfam Description: GRAS family transcription factor
  misc_feature (45)..(115): Pfam Name: DELLA Pfam Description: Transcriptional regulator DELLA protein N terminal
  misc_feature (1)..(579): Bit score of 780.7 for HMM based on sequences of Figure 3
  misc_feature (1)..(579): Functional Homolog Of SEQ ID NO. 188
MKRDLHQFQGPPDTRFPNHGTANTGSSSKDKMMMVKEEEDGGNMDELLAVLGYKVRSSEMAEVALKLEQLETMMGNVQEDGLSNLATDTVHYNPSELYSWLDNMLTEFNPPPPEINNSFLAGAGGSDYDLKAIPGNAIYARSDQFAIDSSSSSNQAGDNSQSTKRLKSCSSPDSLVTGTTVTTTTTESTRSVGLAAESTRSMVLVDSQENGVRLVHALMACAEAIQNNDLSIAEALVKQIGFLAVSQAGAMRKVATYFAEALARRIYRLSPPQTQIDHSLSDTLQMHFYETCPYLKFAHFTANQAILEAFEGKKRVHVIDFSMNQGLQWPALMQALALREGGPPVFRLTGIGPPAADNSDHLHEVGCKLAQLAEAIHVEFEYRGFVANSLADLDASMLELRPSEIEAVAVNSVFELHKLLGRTGGIEKVLGVVKQIKPVIFTVVEQESSHNGPVFLDRFTESLHYYSTLFDSLEGVPSSQDKVMSEVYLGKQICNLVACEGPDRVERHETLSQWANRFGSSGFAPAHLGSNAFKQASMLLALFNGGEGYRVEENNGCLMLGWHTRPLITTSAWKLSAAH

SEQ ID NO: 256 - protein, 639 aa, Malus x domestica
  misc_feature (1)..(639): Public GI ID no. 66816755
  misc_feature (268)..(627): Pfam Name: GRAS Pfam Description: GRAS family transcription factor
  misc_feature (52)..(121): Pfam Name: DELLA Pfam Description: Transcriptional regulator DELLA protein N terminal
  misc_feature (1)..(639): Bit score of 936.0 for HMM based on sequences of Figure 3
  misc_feature (1)..(639): Functional Homolog Of SEQ ID NO. 188
MKREHQTHQLNQYPPPQYPDPSMASTSAGGGGGFCKAKMWEDESQRIDGGMDELLAVLGYKVRSSDMAEVAQKLEQLEEFMGCAQEDGLSQLASDTVHYNPADLSTWLESMISEINLPPPNFDPLTGGAVAGMQPNQQQVQLVDDPFLARGESSITTVDFPDQRKSKSISTSPPQTVFEDCNSSSSYYDFKSIPGNAVFTQTRLDSPSRELKRLKSSSGSSPSELLFNRPAASSLPQPQQPISLPATAESSPTRPALIVDSQENGVRLVHGLMACAEAVQQNNFNLAKALVTQIGYLAGSQAGAMRKVATFFAEALAQRIFRVYPQSPIDHSFSDMLQMHFYETCPYLKFAHFTANQAILESLQGKTRVHVIDFSMNQGMQWPALMQALALRPGGPPAFRLTGIGPPASDNSDHLQEVGWKLAQLAETIHVEFEYRGFVANSLADLDASMLELGPSEVESVAVNSVFELHKLLARPGAIEKVLSVVKQMKPEIVTVVEQEANHNGPVFMDRFNESLHYYSTLFDSLEGSANSRDKVMSEVYLGKQICNVVACEGVDRVERHETLAQWRARFGSADFVPVHLGSNAFKQASMLLALFAGGDGYRVEENDGCMMLAWHTRPLIATSAWKPAYNSVMAHRVE

SEQ ID NO: 257 - protein, 538 aa, Gossypium hirsutum
  misc_feature (1)..(538): Public GI ID no. 238821222
  misc_feature (161)..(526): Pfam Name: GRAS Pfam Description: GRAS family transcription factor
  misc_feature (33)..(100): Pfam Name: DELLA Pfam Description: Transcriptional regulator DELLA protein N terminal
  misc_feature (1)..(538): Bit score of 523.9 for HMM based on sequences of Figure 3
  misc_feature (1)..(538): Functional Homolog Of SEQ ID NO. 188
MLRYDSTSSSAGSSSGSLSSSSSSSKPPQQDIDGLLAGAGYKVRSSELRQVAQRLERLETAMGNSPADFSQLASDAILYNPSDLACWVDSLLTEFAEPPPTCSSDFIVDPVNNQTVVNSAWTTAEPHTPQVHQNITYDEQQSLDNQLTVVTAMEEDSGIRLVHMLMTCAECVQSGDLSLATSLIGDMQGLLTHVNTVCGIGKVAGHFIDALSRRIFQGMGGGSVNGGSAFENEILHHHFYEACPYLKFAHFTANQAILEAFDGHDCVHVVDFNLMHGLQWPALIQALALRPGGPPLLRLTGIGPPSPDGRDSLREIGLRLAELARSVNVRFAFRGVAASRLEDVKPWMLQVNPKEAVAVNSIMQLHRLLGSEQTRNSPIDTVLSWIRGLNPKIMTVVEQEANHNQPGFLDRFTEALYYYSTMFDSLEACRVQPEKALAEIYIQREIGNVVSCEGSARVERHEPLAKWRRRLSGAGFRALHLGSNAFKQASMLLTLFSAEGYSVEENEGCLSLGWHSRPLIAASAWQAVPAWDNHMSSS

SEQ ID NO: 258 - protein, 547 aa, Arabidopsis thaliana
  misc_feature (1)..(547): Public GI ID no. 26451075
  misc_feature (180)..(545): Pfam Name: GRAS Pfam Description: GRAS family transcription factor
  misc_feature (44)..(112): Pfam Name: DELLA Pfam Description: Transcriptional regulator DELLA protein N terminal
  misc_feature (1)..(547): Bit score of 731.4 for HMM based on sequences of Figure 3
  misc_feature (1)..(547): Functional Homolog Of SEQ ID NO. 188
MKRGYGETWDPPPKPLPASRSGEGPSMADKKKADDDNNNSNMDDELLAVLGYKVRSSEMAEVAQKLEQLEMVLSNDDVGSTVLNDSVHYNPSDLSNWVESMLSELNNPASSDLDTTRSCVDRSEYDLRAIPGLSAFPKEEEVFDEEASSKRIRLGSWCESSDESTRSVVLVDSQETGVRLVHALVACAEAIHQENLNLADALVKRVGTLTGSQAGAMGKVATYFAQALARRIYRDYTAETDVCAAVNPSFEEVLEMHFYESCPYLKFAHFTANQAILEAVTTARRVHVIDLGLNQGMQWPALMQALALRPGGPPSFRLTGIGPPQTENSDSLQQLGWKLAQFAQNMGVEFEFKGLAAESLSDLEPEMFETRPESETLVVNSVFELHRLLARSGSIEKLLNTVKAIKPSIVTVVEQEANHNGIVFLDRFNEALHYYSSLFDSLEDSYSLPSQDRVMSEVYLGRQILNVVAAEGSDRVERHETAAQWRIRMKSAGFDPIHLGSSAFKQASMLLSLYATGDGYRVEENDGCLMIGWQTRPLITTSAWKLA

SEQ ID NO: 259 - protein, 580 aa, Malus hupehensis
  misc_feature (1)..(580): Public GI ID no. 152968454
  misc_feature (216)..(574): Pfam Name: GRAS Pfam Description: GRAS family transcription factor
  misc_feature (49)..(118): Pfam Name: DELLA Pfam Description: Transcriptional regulator DELLA protein N terminal
  misc_feature (1)..(580): Bit score of 1011.1 for HMM based on sequences of Figure 3
  misc_feature (1)..(580): Functional Homolog Of SEQ ID NO. 188
MKREHCHSSATASQNNSKPEYSSPPSSALNGKAKIWEDEQGYSGGGDMDELLAVLGYKVRTDDMADVAEKLEQLEMVMGSAQEDGVSQLSDTVHYNPSDLSGWVQSMLSELNTGDDMPSINGPLLAPGESSTITSTSFCNSQRTRVFSDDSEYDLRAIPGVAAYPPAHSSSETESTRKRLKTSIGSNSGRIEVSGAVSDPIRPLVLVDSHETGVQLVHTLMACAEAVQQENLKLADALVKHVGLLAAAQTGAMRKVATYFAEALARRIYRIYPQDCLDSSYSDILQMHFYETCPYLKFAHFTANQAILEAFATATRVHVIDFGLKQGMQWPALMQALALRPGGPPVFRLTGIGPPQPDNTDVLQQVGWKLAQLAETIGVEFEFRGFVANSLADLEPSMLDIRQDEAVAVNSVFKLHGLLARAGAVDKVLSSIKAMKPKIVTIVEQEANHNGPVFLDRFTEALHYYSSLFDSLEGSSGPSQDLVMSEVYLGRQICNVVACEGGDRVERHETLTQWRGRMDSAGFDPVHLGSNAFKQASMLLDLFAGVDGYRVQENNGSLMLGWHTRPLIVTSAWKLASSTE

SEQ ID NO: 260 - protein, 587 aa, Cucurbita maxima
  misc_feature (1)..(587): Public GI ID no. 75121086
  misc_feature (218)..(577): Pfam Name: GRAS Pfam Description: GRAS family transcription factor
  misc_feature (46)..(117): Pfam Name: DELLA Pfam Description: Transcriptional regulator DELLA protein N terminal
  misc_feature (1)..(587): Bit score of 898.7 for HMM based on sequences of Figure 3
  misc_feature (1)..(587): Functional Homolog Of SEQ ID NO. 188
MKREHHHLHPRPDPPSMAAAPNGDTYLNTGKAKLWEEDAQLDGGMDELLAVLGYKVKSSDMAEVAQKLEQLEEAMCQVQDTGLSHLAFDTVHYNPSDLSTWLESMITELHPPPSFPQPHPSQMNDSSFLAPAESSTITSIDYDPQRQTSSLIFEESSSSDYDLKAITSSAIYSPRENKRLKPSSESDSDLFSTSAIGASNSATRPIVLVDSQENGIQLVHALMACAEAVQQNNLNLAEALEKRIGYLAVSQAGAMRKVATFFAEALARRIYRVCPENPLDHSMSDMLQLHFYESSPYLKFAHFTANQAILEAFEGKKRVHVIDFSMNQGMQWPALLQALALRPSGPPAFRLTGIGPPAPDNSDYLQDVGWKLAKLVETINVEFEYRGFVANSLADLDASMLELRPSEVESVVVNSVFELHKLLARPGAIEKVMSVVKQMKPEIMTVVEQEANHNGPVFMDRFTESLHYYSTLFDSLESSPNNQDKMMSEMYLGKQICNVVACEGSDRVEWHETLTQWRTRLCSSGFEPIHLGSNAFKQASMLLALFGSGEGYRVEENNGSLTLGWHTRPLIVTSAWKLGNNSVVVTH

SEQ ID NO: 261 - protein, 492 aa, Sorghum bicolor
  misc_feature (1)..(492): Public GI ID no. 242058173
  misc_feature (79)..(456): Pfam Name: GRAS Pfam Description: GRAS family transcription factor
  misc_feature (2)..(76): Pfam Name: DELLA Pfam Description: Transcriptional regulator DELLA protein N terminal
  misc_feature (1)..(492): Bit score of 454.7 for HMM based on sequences of Figure 3
  misc_feature (1)..(492): Functional Homolog Of SEQ ID NO. 188
MGGASFPFQWPEADPGLDDVTLPPLPTAVPDAAGVAAAAYYADSAADMHAMPHMEALPDFAAALAAMRREEEEAAGIRLVHLLMSCAGAVEAGDHAGASAHLADAHAALAAVSPASGIGRVAVHFTAALSRRLFPPPTPSPPPPAPPAAEVAADHAFLYHRFYEAGPYLKFAHFTANQAILEAVQGCRHVHIIDFSLMQGLQWPALIQALALRPGGPPSLRLTGIGPPSPPGRDDLRDVGVRLADLARSVRVHFSFRGVAANRLDEVRPWMLQVAQGEAVAVNSVLQLHRLLADDASFSADDARPRAPIDAVLDCVASVRPKVLTVVEQEADHNKPGFLDRFTEALFYYSAVFDSLDAASGGAGDAAAEAYLEREICDIVCGEGADRRERHEPLWRWRDRLGRAGLAAVPLGANALRQARMLVGLFSGEGHCVEEAEGCLTLGWHGRPLFSASAWRAAEENNQSDSCNADGSRSSGSGSGSGSEESNISCSS

SEQ ID NO: 262 - protein, 561 aa, Vitis vinifera
  misc_feature (1)..(561): Public GI ID no. 225451401
  misc_feature (179)..(542): Pfam Name: GRAS Pfam Description: GRAS family transcription factor
  misc_feature (46)..(115): Pfam Name: DELLA Pfam Description: Transcriptional regulator DELLA protein N terminal
  misc_feature (1)..(561): Bit score of 878.1 for HMM based on sequences of Figure 3
  misc_feature (1)..(561): Functional Homolog Of SEQ ID NO. 188
MKRDLLDGCGGGGGGGGGGKGEEGSSMVSAKGKMWDDGQQQDAGMDELLAVLGYNVRSSDMVDVAQKLEQLEMVMGNAQEDGISHLSSGTVHYNPSDLSGWVQSMLTELNPPSSAFASSSQQTPNSDYDLSAIPGVAVYRRPDQQGDGEKSSKRMKTASVAESTRPVVVVDSQETGVRLVHTLMACADAVQQDNMKLADALVKHIGLLAASQAGAMRKVATYFAEALARRIYRIYPQDSLESSYSDILQMHFYEACPYLKFAHFTANQAILEAFAGANRVHVIDFGLKQGMQWPALMQALALRPGGPPSFRLTGIGPPQPDNTDALQQVGWKLAQLAETIGVEFEFRGFVANSLADLEPSMLQIRPPEVEAVAVNSVLELHRLLARPGAIEKVLSSIKAMKPKIVTVVEQEASHNGPVFLDRFTEALHYYSNLFDSLEGCGVSPPSSQDLMMSEIYLGRQICNVVACEGAERVERHETLSQWRSRMGSAGFDPVHLGSNAFKQASMLLALFAGGDGYRVEENNGCLMLGWHTRPLIATSAWQLNSNFNPTSTSASTSAHSQ

SEQ ID NO: 263 - DNA, 1602 bp, Arabidopsis thaliana
  misc_feature (1)..(1602): Ceres Annot ID no. 832619
  misc_feature (1)..(1602): Encodes the peptide sequence at SEQ ID NO. 264
atgaagagagatcatcatcatcatcatcatcaagataagaagactatgatgatgaatgaagaagacgacggtaacggcatggatgagcttctagctgttcttggttacaaggttaggtcatccgaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccactacagcgacggctgagtcaactcggcatgttgtcctggttgactcgcaggagaacggtgtgcgtctcgttcacgcgcttttggcttgcgctgaagctgttcagaaagagaatctgactgtagcggaagctctggtgaagcaaatcggattcttagccgtttctcaaatcggagcgatgagaaaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattag

SEQ ID NO: 264 - protein, 533 aa, Arabidopsis thaliana
  misc_feature (1)..(533): Ceres Annot ID no. 832619
  misc_feature (169)..(529): Pfam Name: GRAS Pfam Description: GRAS family transcription factor
  misc_feature (28)..(98): Pfam Name: DELLA Pfam Description: Transcriptional regulator DELLA protein N terminal
  misc_feature (1)..(533): Bit score of 770.6 for HMM based on sequences of Figure 3
  misc_feature (1)..(533): Functional Homolog Of SEQ ID NO. 188
MKRDHHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRKVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 265 - protein, 569 aa, Brassica oleracea
  misc_feature (1)..(569): Public GI ID no. 171702837
  misc_feature (1)..(569): Brassica oleracea var. italica
  misc_feature (204)..(564): Pfam Name: GRAS Pfam Description: GRAS family transcription factor
  misc_feature (45)..(115): Pfam Name: DELLA Pfam Description: Transcriptional regulator DELLA protein N terminal
  misc_feature (1)..(569): Bit score of 768.2 for HMM based on sequences of Figure 3
  misc_feature (1)..(569): Functional Homolog Of SEQ ID NO. 188
MKRDLHQFQGPPDTRFPNHETANTGSSSKDKMMKVKEEEDGGNMDELLAVLGYKVRSSEMAEVALKLEQLETMMGNVQEDGLSNLATDTVHYNPSELYSWLDNMLTEFNPPPPEINNSFLAGAGGSDYDLKAIPGNAIYARSNQFAIDSSSSSNQAGDNSQSTKRLKSCSSPDSLVTGTTVTTTTIESTRSMVLVDSQENGVRLVHALMACAEAIQNNDLSIAEALVKQIGFLAVSQAGAMRKVATYFAEALARRIYRLSPPQTQIDHSLSDTLQMHFYETCPYLKFAHFTANQAILEAFEGKKRVHVIDFSMNQGLQWPALMQALALREGGPPVFRLTGIGPPAADNSDHLHEVGCKLAQLAEAIHVEFEYRGFVANSLADLDASMLELRPSEIEAVAVNSVFELHKLLGRTGGIEKVLGVVKQIKPVIFTVVEQESNHNGPVFLDRFTESLHYYSTLFDSLEGVPSSQDKVMSEVYLGKQICNLVACEGPDRVERHETLSQWANRFGTSGFAPAHLGSNAFKQASMLLALFNGGEGYSVEENNGCLMLGWHTRPLITTSAWKLLAAH

SEQ ID NO: 266 - protein, 537 aa, Gossypium hirsutum
  misc_feature (1)..(537): Public GI ID no. 75148243
  misc_feature (171)..(528): Pfam Name: GRAS Pfam Description: GRAS family transcription factor
  misc_feature (37)..(106): Pfam Name: DELLA Pfam Description: Transcriptional regulator DELLA protein N terminal
  misc_feature (1)..(537): Bit score of 810.1 for HMM based on sequences of Figure 3
  misc_feature (1)..(537): Functional Homolog Of SEQ ID NO. 188
MKRDHQEISGSGSNPAESSSIKGKLWEEDPDAGGMDDELLAVLGYKVRSSDMADVAQKLEMLEKVMGTAQEDGISQLGDTVHFNPSDLSGWVQNLLIEFNGSTTTPDPNFNDDSEYDLRAIPGVAAYPPVKSDPGLEITRKRAKTESSSSSSSTTTRPVVLIDSQEAGVRLVHTLMACAEAVQQDNLKLADALVKHIGLLASSQTGAMRKVATYFAEALARRIYRIFPPDSLDPSYNDKLQIPFYETCPYLKFAHFTANQAILEAFSMASRVHVIDFGLKQGMQWPALMQALALRPGGPPAFRLTGIGPPQPDNTDALQQVGWKLAQLAERIGIEFEFRGFVANSLADLEPEMLDIRPPEIEVVAVNAVFELHPLLARPGGIEKVVSSIKAMKPKIVTVVEQEANHNGPVFLDRFTEALHYYSTLFDSLEGSGVAPASQDLAMSELYLGRQICNVVACEGMDRVERHEPLTQWRTRMETAGVSPVHLGSNAYKQASMLLALFASGDGYRVEENNGCLMLGWHTRPLIAHLGLATRWY

SEQ ID NO: 267 - protein, 542 aa, Argyroxiphium sandwicense
  misc_feature (1)..(542): Public GI ID no. 20257457
  misc_feature (1)..(542): Argyroxiphium sandwicense subsp. macrocephalum
  misc_feature (193)..(542): Pfam Name: GRAS Pfam Description: GRAS family transcription factor
  misc_feature (24)..(91): Pfam Name: DELLA Pfam Description: Transcriptional regulator DELLA protein N terminal
  misc_feature (1)..(542): Bit score of 862.1 for HMM based on sequences of Figure 3
  misc_feature (1)..(542): Functional Homolog Of SEQ ID NO. 188
MKRSRERKKEAKTTSSVPDSGGMDELLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHKDLKLADALVKHVGILVASQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADINANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 268 - protein, 538 aa, Dubautia arborea
  misc_feature (1)..(538): Public GI ID no. 20257422
  misc_feature (189)..(538): Pfam Name: GRAS Pfam Description: GRAS family transcription factor
  misc_feature (24)..(87): Pfam Name: DELLA Pfam Description: Transcriptional regulator DELLA protein N terminal
  misc_feature (1)..(538): Bit score of 871.9 for HMM based on sequences of Figure 3
  misc_feature (1)..(538): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLSVLNENTPPSDHIVLSGDSSTTMIDFSNSSEIVVHGKQGSKMHEDDPYDLRAIAGGAIYGGESESSVRGNGNGNGIKRMKSTAVGSVDVQPESPRRVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 269 - protein, 616 aa, Eutrema halophilum
  misc_feature (1)..(616): Public GI ID no. 312281569
  misc_feature (251)..(611): Pfam Name: GRAS Pfam Description: GRAS family transcription factor
  misc_feature (56)..(122): Pfam Name: DELLA Pfam Description: Transcriptional regulator DELLA protein N terminal
  misc_feature (1)..(616): Bit score of 924.5 for HMM based on sequences of Figure 3
  misc_feature (1)..(616): Functional Homolog Of SEQ ID NO. 188
MKRDLHQYQGRNTRLSSHGTAIAGSSSSSSSLPAAACANKDKMMMVKEEEDGGNMDELLAVLGYKVRSSEMAEVALKLEQLETMMGNVQEDGLSHLATDTVHYNPSELYSWLDNMLSELNPSAVPASGSNGLNPILPSPEIDNSFFTGAGDSSAIGGFSASDYDLKAIPGNAIYRRSNQFAIDSSSSSNNNQNNKRLKSCSSPDSMVTSTSTAAQIGGVIGTTATTTTTSTATESTRAVILVDSQENGVRLVHALMACAEAIQSNNLTLAEALVKQIGLLAVSQAGAMRKVATYFAEALARRIYRLSPPQNQIDHSLSDTLQMHFYETCPYLKFAHFTANQAILEAFEGKKRVHVIDFSMNQGLQWPALMQALALREGGPPVFRLTGIGPPAADNSDHLHEVGCKLAQLAEAIHVEFEYRGFVANSLADLDASMLELRPSEIESVAVNSVFELHKLLGRPGGIEKVLGVVKQIKPVIFTVVEQESNHNGPVFVDRFTESLHYYSTLFDSLEGVPSSQDKVMSEVYLGKQICNLVACEGPDRVERHEMLSQWANRFGSSGFAPAHLGSNAFKQASMLLALFNGGEGYRVEENNGCLMLGWHTRPLITTSAWKLSTAH

SEQ ID NO: 270 - protein, 625 aa, Oryza sativa
  misc_feature (1)..(625): Public GI ID no. 125545440
  misc_feature (1)..(625): Oryza sativa Indica Group
  misc_feature (241)..(621): Pfam Name: GRAS Pfam Description: GRAS family transcription factor
  misc_feature (39)..(113): Pfam Name: DELLA Pfam Description: Transcriptional regulator DELLA protein N terminal
  misc_feature (1)..(625): Bit score of 1168.8 for HMM based on sequences of Figure 3
  misc_feature (1)..(625): Functional Homolog Of SEQ ID NO. 188
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPAMQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 271 - DNA, 1878 bp, Populus trichocarpa
  misc_feature (1)..(1878): Ceres Annot ID no. 1449379
  misc_feature (1)..(1878): Encodes the peptide sequence at SEQ ID NO. 272
atgaagagagatcatcaagaaaccattggtggtggtattggaaacagagctgaatcttcttcttcatcaatggaaactgggaaaggaaaatcatgggttgaagatgatcaagatgcgggtggcatggatgaattacttgctgttttgggttacaaaattaagtcttcagatatggctgatgtagctcaaaagcttgaacaactagagatggttttgggttctgaagatggaatttctcatcttgcttctgatactgttcactataacccttcagatctctctggttgggttcaaagtatgctttctgaattcaacaatctaccttctactgatcttgattcatctattcttctttccaataatcgagattcactccttggacaaccttccactatcacccccttagatttccccagtaattctcaatctaaagtattcgctgacgactctgaatatgatctcagagcaatccctggagttgctgcctatccacaacaagaactcgataagagtaacgacaggaagcgaatgaagctcactccaattgggtctaatattgcgccggcaccatctgtgaattccttacaatctcccactgcatcttccacttcttcttcatctccgcaagcaatggcagtttcaggtactttgtcagagcccacaagacctgtagtcctggttgactcacaggaaactggagtccgtcttgtccacacacttttggcttgtgcagaggcaattcagcaagaaaatcttaaacttgctgatgcccttgttaagcatataggactacttgcagcatctcaaactggggctatgagaaaagttgcaacttacttcgctgaagctttagctcgtcgaatttacaagattttccctcaagattactgtctcgattcttcatgttcagatactttagagatgcatttctacgaaacttgcccttatctcaagttcgcacatttcactgccaatcaagccattcttgaagctttcgcgaatgcaagtcgagtccacgttatcgattttggtttaaaacagggaatgcaatggccggcgttaatgcaagctcttgcattaaggcctggtggtccgccagcgtttcggttgacggggatcgggccgccgcagcctgataacacagatgctttgcagcaagtggggtggaagctggcacaattggctcaaactattggagtagaattcgagtttcgcggattcgtagcaaactctctggcggatcttgatgcggagatgcttggcctcctccctccagaggtggaggcagtggctgttaactcggtttttgagctgcatcgcttgttgggtcggccgggtggcatcgacaaggttctcgagtctatcaaggccatgagacctaaaattgtgacgattgttgaacaagaagcaaaccacaacggtccggtttttctagaccggttcacagaggccttacattattactcgagtttgtttgactctctcgaagggtccggtttgactccaccgagtcaggacctggttatgtccgagctgtacttagggaggcatatttgtaatgtggtggcatgcgaaggggctgaccgagttgagcgacacgagacgttggctcagtggagaactcggtttgattcggctgggtttgacccggttcatcttgggtcgaatgcctttaaacaagctagtatgttgttggccctctttgccggtggtgacggtaaggaaacggaggccacatgtgaaggatacttcttctcccatgtcacctccgccgtgagaaaattctcacagcactgtctagcagtcgtctctagactcatgggtgtgactaagaaagaaagatggaaaaccttcatggcaatggcacctggaccttag

SEQ ID NO: 272 - protein, 625 aa, Populus trichocarpa
  misc_feature (1)..(625): Ceres Annot ID no. 1449379
  misc_feature (236)..(577): Pfam Name: GRAS Pfam Description: GRAS family transcription factor
  misc_feature (43)..(111): Pfam Name: DELLA Pfam Description: Transcriptional regulator DELLA protein N terminal
  misc_feature (1)..(625): Bit score of 1010.5 for HMM based on sequences of Figure 3
  misc_feature (1)..(625): Functional Homolog Of SEQ ID NO. 188
MKRDHQETIGGGIGNRAESSSSSMETGKGKSWVEDDQDAGGMDELLAVLGYKIKSSDMADVAQKLEQLEMVLGSEDGISHLASDTVHYNPSDLSGWVQSMLSEFNNLPSTDLDSSILLSNNRDSLLGQPSTITPLDFPSNSQSKVFADDSEYDLRAIPGVAAYPQQELDKSNDRKRMKLTPIGSNIAPAPSVNSLQSPTASSTSSSSPQAMAVSGTLSEPTRPVVLVDSQETGVRLVHTLLACAEAIQQENLKLADALVKHIGLLAASQTGAMRKVATYFAEALARRIYKIFPQDYCLDSSCSDTLEMHFYETCPYLKFAHFTANQAILEAFANASRVHVIDFGLKQGMQWPALMQALALRPGGPPAFRLTGIGPPQPDNTDALQQVGWKLAQLAQTIGVEFEFRGFVANSLADLDAEMLGLLPPEVEAVAVNSVFELHRLLGRPGGIDKVLESIKAMRPKIVTIVEQEANHNGPVFLDRFTEALHYYSSLFDSLEGSGLTPPSQDLVMSELYLGRHICNVVACEGADRVERHETLAQWRTRFDSAGFDPVHLGSNAFKQASMLLALFAGGDGKETEATCEGYFFSHVTSAVRKFSQHCLAVVSRLMGVTKKERWKTFMAMAPGP

SEQ ID NO: 273 - protein, 579 aa, Brassica napus
  misc_feature (1)..(579): Public GI ID no. 290988843
  misc_feature (214)..(574): Pfam Name: GRAS Pfam Description: GRAS family transcription factor
  misc_feature (45)..(115): Pfam Name: DELLA Pfam Description: Transcriptional regulator DELLA protein N terminal
  misc_feature (1)..(579): Bit score of 777.6 for HMM based on sequences of Figure 3
  misc_feature (1)..(579): Functional Homolog Of SEQ ID NO. 188
MKRDLHQFQGPPDTRFPNHGTANTGSSSKDKMMMVKEEEDGGNMDELLAVLGYKVRSSEMAEVALKLEQLETMMGNVQEDGLSNLATDTVHYNPSELYSWLDNMLTEFNPPPPEINNSFLAGAGGSDYDLKAIPGNAIYARSDQFAIDSSSSSNQAGDNSQSTKRLKSCSSPDSLVTGTTVTTTTTESTRSVGLAAESTRSMVLVDSQENGVRLVHALMACAEAIQNNDLSIAEALVKQIGFLAVSQAGAMRKVATYFAEALARRIYRLSPPQTQIDHSLSDTLQMHFYETCPYLKFAHFTANQAILEAFEGKKRVHVIDFSMNQGLQWPALMQALALREGGPPVFRLTGIGPPAADNSDHLHEVGCKLAQLAEAIHVEFEYRGFVANSLADLDASMLELRPSEIEAVAVNSVFELHKLLGRTGGIEKVLGVVKQIKPVIFTVVEQESSHNGPDFLDRFTESLHYYSTLFDSLEGVPSSQDKVMSEVYLGKQICNLVACEGPDRVERHETLSQWANRFGTSGFAPAHLGSNAFKQASMLLALFNGGEGYRVEENNGCLMLGWHTRPLITTSAWKLSAAH

SEQ ID NO: 274 - protein, 508 aa, Zea mays
  misc_feature (1)..(508): Public GI ID no. 224032153
  misc_feature (99)..(475): Pfam Name: GRAS Pfam Description: GRAS family transcription factor
  misc_feature (2)..(87): Pfam Name: DELLA Pfam Description: Transcriptional regulator DELLA protein N terminal
  misc_feature (1)..(508): Bit score of 318.0 for HMM based on sequences of Figure 3
  misc_feature (1)..(508): Functional Homolog Of SEQ ID NO. 188
MDAHTTHIVARKNTSLSFTSNELMDHFPFAWLPMDPFTAMALSGTLSPSFSTTSTNDTMYNLNPALYASLVPPIRKPATPTTLEVGRQCKEEEDASIRLVHLLITCTSAIETGDYSIAQGNLSEARKILGEIPTSTGIGRVGKHFIDALVQRLFPAYPHAAPPSPSPSTSIDLHNNFYDAGPYLKFAYSTANQAILKAIKGYNHVHIIDFSLMQGLQWPALMDVFSAREGGPPKLRITGIGPNPIGGRDELHEVGIRLAKYAHSVGIDFTFQGVCVDQLDRLCDWMLLKPIKGEAVAINSILQLHRLLVDPDANPVVPAPIDILLKLVIKINPMIFTVVEHEADHNRPPLLERFTNALFHYATMFDSLEAMHRCTSGRDITDSLTEVYLRGEIFDIVCGEGSARTERHELFGHWRERLTYAGLTQVWFDPDEVDTLKDQLIHVTSLSGSGFNILVCDGSLALAWHNRPLYVATAWCVTGGNAASSMVGNICKGTNDSRRKENRNGPME

SEQ ID NO: 275 - protein, 660 aa, Vitis vinifera
  misc_feature (1)..(660): Public GI ID no. 225451515
  misc_feature (295)..(659): Pfam Name: GRAS Pfam Description: GRAS family transcription factor
  misc_feature (40)..(109): Pfam Name: DELLA Pfam Description: Transcriptional regulator DELLA protein N terminal
  misc_feature (1)..(660): Bit score of 362.8 for HMM based on sequences of Figure 3
  misc_feature (1)..(660): Functional Homolog Of SEQ ID NO. 188
MGSLNSESSCTKLQQPTSPNKSILESRKAPLSSDLESNSLAPSSLNLHGLKFDVDGDAEVQSPDSSMWEAFFTDHFDSDFMISSPVRSSPMNYNYNHVQSMQGQSLLGCSPPRNSSQLGSFSSTHKGKGQSPLHKVFNSPTYQYIQPDTLSLPPLDSLLDDYQRDGVGASSYPMMKIPAVGISGASSLAQYLDMPITIHPTALDLPLQNTWRFSGPVSESSATGGSQLTQEKDMYQMGSMSSTASLSQQLQEEHQQEQQLQQKQQQLQEIQNPNHGLMVPHPLGSEQEHDSGLQLVHFLLACAEAVAKEDYMLARRYLHHLNRVVTPLGDSMQRVASCFTEALSARLAATLTPKPSTSTTKPFNPFPPNSLEILKIYQILYQACPYIKFAHFTANQAIFEAFEAEERVHVIDLDILQGYQWPAFIQALAARPGGAPFLRITGVGCSPESVRETGRCLTELAHSLHVPFEFHPVGEELEDLKPHMFNRRVGEALAVNSANRLHRVPTNFLGNLLAMIRDQAPNIVTIVEQEASHNGPYFLGRFLEALHYYSAIFDSLDATFPPDSAQRAKLEQYIFAPVIRNIVACEGAERVMRHERLEKWRKLMEGKGFQGVPLSANAVTQSKILLGLYSCDGYRLTEDKGCLLLGWQDRAILAASAWRC

SEQ ID NO: 276 - protein, 590 aa, Vitis vinifera
  misc_feature (1)..(590): Public GI ID no. 339779229
  misc_feature (214)..(575): Pfam Name: GRAS Pfam Description: GRAS family transcription factor
  misc_feature (35)..(106): Pfam Name: DELLA Pfam Description: Transcriptional regulator DELLA protein N terminal
  misc_feature (1)..(590): Bit score of 954.6 for HMM based on sequences of Figure 3
  misc_feature (1)..(590): Functional Homolog Of SEQ ID NO. 188
MKREYHHPHHPTCSTSPTGKGKMWDADPQQDAGMDELLAVLGYNVKASDMAEVAQELEQLEEVIVNAQEDGLSHLASETVHYNPSDLSNWLGSMLSEFNPTPNCALDNPFLPPISPLDYTNCSTQPKQEPSIFDSPSLDYDLKAIPGKALYSHIEQPPQQPPAPPLYQRDNKRSKPTASATANSVSSVIGGWGVPTESARPVVLVDSQETGIRLVHTLMACAEAVQQENLKLAEALVKQIGFLAVSQAGAMRKVATYFAEGLARRIYRLYPDKPLDSSFSDILQMHFYETCPYLKFAHFTANQAILEAFEGKKRVHVIDFSMKQGMQWPALMQALALRPGGPPSFRLTGIGPPSTDNTDHLHEVGWKLAQLAETIHVEFEYRGFVANSLADLDASMLELRDGESVAVNSVFELHSLLARPGGIERVLSAVKDMKPDIVTIVEQEANHNGPVFLDRFTESLHYYSTLFDSLEGCGVSPVNTQDKLMSEVYLGQQICNVVACEGPERVERHETLAQWRARLGSAGFDPVNLGSNAFKQASMLLALFAGGDGYRVEENNGCLMLGWHTRPLIATSAWQLANKPALPSSTPASN

SEQ ID NO: 277 - protein, 588 aa, Solanum lycopersicum
  misc_feature (1)..(588): Public GI ID no. 75146039
  misc_feature (199)..(574): Pfam Name: GRAS Pfam Description: GRAS family transcription factor
  misc_feature (42)..(108): Pfam Name: DELLA Pfam Description: Transcriptional regulator DELLA protein N terminal
  misc_feature (1)..(588): Bit score of 1041.6 for HMM based on sequences of Figure 3
  misc_feature (1)..(588): Functional Homolog Of SEQ ID NO. 188
  misc_feature (1)..(588): in Figure 3
MKRDRDRDREREKRAFSNGAVSSGKSKIWEEDEEEKPDAGMDELLAVLGYKVKSSDMADVAQKLEQLEMAMGTTMEDGITHLSTDTVHKNPSDMAGWVQSMLSSISTNFDMCNQENDVLVSGCGSSSSIIDFSQNHRTSTISDDDLRAIPGGAVFNSDSNKRHRSTTSSFSTTSSSMVTDSSATRPVVLVDSQETGVRLVHTLMACAEAVQQENLTLADQLVRHIGILAVSQSGAMRKVATYFAEALARRIYKIYPQDSMESSYTDVLQMHFYETCPYLKFAHFTANQAILEAFTGCNKVHVIDFSLKQGMQWPALMQALALRPGGPPAFRLTGIGPPQPDNTDALQQVGWKLAQLAETIGVEFEFRGFVANSLADLDATILDIRPSETEAVAINSVFELHRLLSRPGAIEKVLNSIKQINPKIVTLVEQEANHNAGVFIDRFNEALHYYSTMFDSLESSGSSSSASPTGILPQPPVNNQDLVMSEVYLGRQICNVVACEGSDRVERHETLNQWRVRMNSSGFDPVHLGSNAFKQASMLLALFAGGDGYRVEENDGCLMLGWHTRPLIATSAWKLLPDSGTGAGEVEL

SEQ ID NO: 278 - protein, 622 aa, Zea mays
  misc_feature (1)..(622): Public GI ID no. 115184074
  misc_feature (236)..(618): Pfam Name: GRAS Pfam Description: GRAS family transcription factor
  misc_feature (37)..(110): Pfam Name: DELLA Pfam Description: Transcriptional regulator DELLA protein N terminal
  misc_feature (1)..(622): Bit score of 1143.9 for HMM based on sequences of Figure 3
  misc_feature (1)..(622): Functional Homolog Of SEQ ID NO. 188
MKREYQNAGGSDGYMGSSKDKSMAAAAGAGEQEEEVDELLAALGYKVRSSDMADVAQKLEQLEMAMGMGGACPTADDGFVSHLATDTVHYNPSDLSSWVESMLSELNTPPPPLPPATPAPRLASTSSTVTSGAAAGAGYFDLPPAVDSSSSTYALKPIPSPVAAASADPSPDSAREPKRMRTGGGSTSSSSSSSSSMDGGRTRSSVVEAAPPATQAANGPAVPVVVVDTQEAGIRLVHALLACAEAVQQENFSAADALVKQIPVLASSQGGAMRKVAAYFGEALARRVYRLRPAPDGSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLRPEGDGDTDDEPEVIAVNSVCELHRLLAQPGTLDKVLGTVRAVRPRIVTVVEQEANHNSGTFLDRFTESLHYYSTMFDSLEGAGSGSGQPTDASSPAAAGGTDQVMSEVYLGRQICNIVACEGAERTERHETLVQWRGRLGGSGFEPVHLGSNAYKQASTLLALFAGGDGYRVEKKDGCLTLGWHTRPLIATSAWRVAAP

SEQ ID NO: 279 - protein, 635 aa, Malus x domestica
  misc_feature (1)..(635): Public GI ID no. 321442634
  misc_feature (267)..(626): Pfam Name: GRAS Pfam Description: GRAS family transcription factor
  misc_feature (51)..(119): Pfam Name: DELLA Pfam Description: Transcriptional regulator DELLA protein N terminal
  misc_feature (1)..(635): Bit score of 943.2 for HMM based on sequences of Figure 3
  misc_feature (1)..(635): Functional Homolog Of SEQ ID NO. 188
  misc_feature (629)..(629): Xaa is any aa, unknown, or other
MKGEHQIHQLNQYPLPQQHPDPSMASASAGGGFGKAKMWEDESQRMDGGMDELLAVLGYKVRSSDMADVAQKLEQLEEFMGCAQEDGLSQLASDTVHYNPSDLSTWLETMISEINVPPPNFDPLMGGAVAGIQLSQQQVQLVDDPFLAPAESSITTVDFPDHRKSKSMSTSPTQNVFEDCNSSSSYYDFKSIPGNAVFTKTRLDSSSREPKRLKSSSGSSPSDLLFNRPAASSLPQPQQPISLPAPAESSSTRPALLVDSQENGVRLVHGLMACAEAVQQNNFNLAKALVTQIGYLAGSQAGAMRKVATFFAEALAHRIFRVYPQPPIDHSFSDMLQMHFYETCPYLKFAHFTANQAILESLHGKTRVHVIDFSMNQGMQWPALMQALALRPGGPPAFRLTGIGPPASDNSDHLQEVGWKLAQLAETIHVEFEYRGFVANSLADLDASMLELRPSEAESVAVNSVFELHKLLARPGAIEKVLSVVKQMKPEILTVVEQEANHNGPVFMDRFNESLHYYSTLFDSLEGSANSQDKVMSEVYLGKQICNVVACEGLDRVERHETLTQWRARFDSADFVPVHLGSNAFKQASMLLALFAGGDGYRVEENDGCLMLGWHTRPLIATSAWKPSXNSVIAH

SEQ ID NO: 280 - protein, 548 aa, Gossypium hirsutum
  misc_feature (1)..(548): Public GI ID no. 63054405
  misc_feature (171)..(533): Pfam Name: GRAS Pfam Description: GRAS family transcription factor
  misc_feature (37)..(106): Pfam Name: DELLA Pfam Description: Transcriptional regulator DELLA protein N terminal
  misc_feature (1)..(548): Bit score of 827.4 for HMM based on sequences of Figure 3
  misc_feature (1)..(548): Functional Homolog Of SEQ ID NO. 188
MKRDHQEISGSGSNPAESSSIKGKLWEEDPDAGGMDDELLAVLGYKVRSSDMADVAQKLEMLEKVMGTAQEDGISQLGDTVHFNPSDLSGWVQNLLIEFNGSTTTPDPNFNDDSEYDLRAIPGVTAYPPVKSDPGLENTRKRAKTESSSSSSSTTTRPVVLIDSQETGVRLVHTLMACAEAVQQDNLKLADALVKHIGLLASSQTGAMRKVATYFAEALARRIYRIFPPDSLDPSYNDKLQMHFYETCPYLKFAHFTANQAILETFSMANRVHVIDFGLKQGMQWPALMQALALRPGGPPAFRLTGIGPPQPDDTDALQQVGWKLAELAERIGIEFEFPGFVANSLADLEPEMLDIRPPEIEVVAVNAVFELHPLLARPGGIEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFASGDGYRVEENNGCLMLGWHTRPLIATSAWRLAGTESGSELTQELS

SEQ ID NO: 281 - DNA, 2153 bp, Glycine max
  misc_feature (1)..(2153): Ceres Clone ID no. 479467
  misc_feature (1)..(2153): Encodes the peptide sequence at SEQ ID NO. 282
tctctccgtttcccctttagacctctctctcacttgaaactccacaaccccattttcctttcctatgaccctattccaaatcaccaattctaattccattcttcaggtgttcaattgaattcgtgatgaagagggatcaccgagatagctgcggcggcggcggcggagggagtgtgaagggtgagtgttcctcaatgccgtcgaacgggaaggcaaatatgtgggaggaacaacaacaacaacaacaggggatggacgagttgctggcggcgttggggtacaaggttcgtgcttccgacatggccgacgtggcacagaagctggagcagttggagatggtcatgggttgtgcccaggaagagggaatttcccacctcgcctccgacaccgtccactacgatcccacggatctttattcctgggtccaaaccatgttaaccgaactcaaccctgaacccaacaacaacaacaatagcctcctcggtccatcttctctcttaatcgacaacaacaccgcccctgttttcaacgacgattccgaatatgacctcagagccattcctggtattgcagcctaccctcctcctcctccacaagacaacaacaacaacaacaacaacctcgacgaaatcgaaacagctaacaacatcaacaagcgtctcaagccatctccagttgaatcagcagactccgcgtctgagcccacgcgcacggtgctgctcgttgaccatcaggaagccggcgtgcgtctggtccacactctcctggcgtgcgcggaggccgtccagcaggagaatctgaagctggccgacgcgctcgtcaagcacgtgggcatactcgcggcttctcaagccggcgccatgaggaaggtggcttcctacttcgcccaagccctcgcgcgtcgtatctacggaatcttcccggaagaaaccctcgactcctccttctccgacgttctccacatgcacttctacgagtcctgcccttacctcaaattcgcgcacttcaccgcgaatcaggctatcctcgaagcatttgccactgctgggagagtccacgtcatcgatttcggcctcagacaagggatgcagtggcctgcactcatgcaagcccttgcattgcggcccggcgggcccccgactttccgtctaaccggaatcggcccgccgcagcccgacaacaccgacgcgctgcagcaagtgggctggaaattagcccaattggcccagaacatcggcgtccagttcgaattccgcggcttcgtttgcaacagcctcgcggatctcgacccgaaaatgctcgagatccgacccggagaagccgtcgctgtcaactcggttttcgagctccatcgtatgctggcccgccccggatccgtcgacaaggtcttggacactgttaagaaaatcaagccgaagattgtcaccatcgtggaacaagaagcgaaccacaacggaccgggttttcttgaccggttcactgaggccttgcattactactccagcctattcgactcgctggagggttcgtcctcttcgaccgggttgggctcaccaaatcaggatctgttaatgtccgagttgtacctggggagacaaatatgcaacgtggtggctaacgagggcgcggaccgggtagagcgtcacgagactttgagtcagtggagggggagattggactcggccgggttcgacccggttcatctcgggtccaacgcgttcaagcaagcgagtatgctacttgctctattcgcaggcggtgacggctatagggttgaggagaataacggctgcctcatgcttggctggcacactcggccactcatcgctacctccgcctggaagcttccctccccgaacgacttgcactgtaaactgtagattaattggctcctggatgggtggtaaataataaaaaatggtttggttgaacttgttcgagtggagtgaatcaatgacccagtgagtcagtgagtcagtgagcgagccagcgaggcagcaagaggataaataaatgagagggtaaaaaaacaaaaaagtaaaaaagaaaaacaaaagactgtaatttgtaattgtgctctcgtaattaccgtttctcctctttagtgtttttttttcctttctctaaattattatataatttgtttaattctt

SEQ ID NO: 282 - protein, 584 aa, Glycine max
  misc_feature (1)..(584): Ceres Clone ID no. 479467
  misc_feature (209)..(573): Pfam Name: GRAS Pfam Description: GRAS family transcription factor
  misc_feature (44)..(116): Pfam Name: DELLA Pfam Description: Transcriptional regulator DELLA protein N terminal
  misc_feature (1)..(584): Bit score of 1064.4 for HMM based on sequences of Figure 3
  misc_feature (1)..(584): Functional Homolog Of SEQ ID NO. 188
  misc_feature (1)..(584): in Figure 3
MKRDHRDSCGGGGGGSVKGECSSMPSNGKANMWEEQQQQQQGMDELLAALGYKVRASDMADVAQKLEQLEMVMGCAQEEGISHLASDTVHYDPTDLYSWVQTMLTELNPEPNNNNNSLLGPSSLLIDNNTAPVFNDDSEYDLRAIPGIAAYPPPPPQDNNNNNNNLDEIETANNINKRLKPSPVESADSASEPTRTVLLVDHQEAGVRLVHTLLACAEAVQQENLKLADALVKHVGILAASQAGAMRKVASYFAQALARRIYGIFPEETLDSSFSDVLHMHFYESCPYLKFAHFTANQAILEAFATAGRVHVIDFGLRQGMQWPALMQALALRPGGPPTFRLTGIGPPQPDNTDALQQVGWKLAQLAQNIGVQFEFRGFVCNSLADLDPKMLEIRPGEAVAVNSVFELHRMLARPGSVDKVLDTVKKIKPKIVTIVEQEANHNGPGFLDRFTEALHYYSSLFDSLEGSSSSTGLGSPNQDLLMSELYLGRQICNVVANEGADRVERHETLSQWRGRLDSAGFDPVHLGSNAFKQASMLLALFAGGDGYRVEENNGCLMLGWHTRPLIATSAWKLPSPNDLHCKL

SEQ ID NO: 283 - protein, 623 aa, Triticum aestivum
  misc_feature (1)..(623): Public GI ID no. 75207630
  misc_feature (234)..(619): Pfam Name: GRAS Pfam Description: GRAS family transcription factor
  misc_feature (38)..(113): Pfam Name: DELLA Pfam Description: Transcriptional regulator DELLA protein N terminal
  misc_feature (1)..(623): Bit score of 1131.6 for HMM based on sequences of Figure 3
  misc_feature (1)..(623): Functional Homolog Of SEQ ID NO. 188
  misc_feature (1)..(623): in Figure 3
MKREYQDAGGSGGGGGGMGSSEDKMMVSAAAGEGEEVDELLAALGYKVRASDMADVAQKLEQLEMAMGMGGVGAGAAPDDSFATHLATDTVHYNPTDLSSWVESMLSELNAPPPPLPPAPQLNASTSSTVTGSGGYFDLPPSVDSSSSIYALRPIPSPAGATAPADLSADSVRDPKRMRTGGSSTSSSSSSSSSLGGGARSSVVEAAPPVAAAANATPALPVVVVDTQEAGIRLVHALLACAEAVQQENLSAAEALVKQIPLLAASQGGAMRKVAAYFGEALARRVFRFRPQPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVFEMHRLLAQPGALEKVLGTVRAVRPRIVTVVEQEANHNSGTFLDRFTESLHYYSTMFDSLEGGSSGGGPSEVSSGAAAAPAAAGTDQVMSEVYLGRQICNVVACEGAERTERHETLGQWRNRLGNAGFETVHLGSNAYKQASTLLALFAGGDGYKVEEKEGCLTLGWHTRPLIATSAWRLAGP

SEQ ID NO: 284 - protein, 580 aa, Arabidopsis lyrata
  misc_feature (1)..(580): Public GI ID no. 297817754
  misc_feature (1)..(580): Arabidopsis lyrata subsp. lyrata
  misc_feature (214)..(574): Pfam Name: GRAS Pfam Description: GRAS family transcription factor
  misc_feature (41)..(109): Pfam Name: DELLA Pfam Description: Transcriptional regulator DELLA protein N terminal
  misc_feature (1)..(580): Bit score of 902.3 for HMM based on sequences of Figure 3
  misc_feature (1)..(580): Functional Homolog Of SEQ ID NO. 188
MKRDLHQFQGRLSNHGTSSSSSSKDKMMMVKKEEDGGNMDDELLAVLGYKVRSSEMAEVALKLEQLETMMGNVQEDGLSHLATDTVHYNPSELYSWLDNMLSDLNPPPPRSNGLDPILPSPEIGGFPASDYDLKAIPGNAIYHQNQFPAIDSSSSSNNQSKRLKSCSSPDSMVTSTSTATQIGGVIGTTVTTTTAAESTRSVILVDSQENGVRLVHALMACAEAIQQNNLTLAEALVKQIGCLAVSQAGAMRKVATYFAEALARRIYRLSPPQNQIDHSLSDTLQMHFYETCPYLKFAHFTANQAILEAFEGKKRVHVIDFSMNQGLQWPALMQALALREGGPPTFRLTGIGPPAPDNSDHLHDVGCRLAQLAEVIHVEFEYRGFVANSLADLDASMLELRPSETEAVAVNSVFELHKLLGRPGGIEKVLGVVKQIKPVIFTVVEQESNHNGPVFLDRFTESLHYYSTLFDSLEGVPSSQDKVMSEVYLGKQICNLVACEGPDRVERHETLSQWGNRFGSSGFAPANLGSNAFKQASMLLSVYNSGQGYRVEENNGCLMLGWHTRPLITTSAWKLSTAAH

SEQ ID NO: 285 - protein, 587 aa, Arabidopsis thaliana
  misc_feature (1)..(587): Public GI ID no. 2339978
  misc_feature (221)..(581): Pfam Name: GRAS Pfam Description: GRAS family transcription factor
  misc_feature (44)..(111): Pfam Name: DELLA Pfam Description: Transcriptional regulator DELLA protein N terminal
  misc_feature (1)..(587): Bit score of 905.9 for HMM based on sequences of Figure 3
  misc_feature (1)..(587): Functional Homolog Of SEQ ID NO. 188
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAAESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAH

SEQ ID NO: 286 - protein, 584 aa, Malus x domestica
  misc_feature (1)..(584): Public GI ID no. 66816747
  misc_feature (218)..(578): Pfam Name: GRAS Pfam Description: GRAS family transcription factor
  misc_feature (52)..(121): Pfam Name: DELLA Pfam Description: Transcriptional regulator DELLA protein N terminal
  misc_feature (1)..(584): Bit score of 1063.9 for HMM based on sequences of Figure 3
  misc_feature (1)..(584): Functional Homolog Of SEQ ID NO. 188
  misc_feature (1)..(584): in Figure 3
MKRDHRDSRATVTARENNSKPEYSSPPSSALNGKAKIWEDDQDGYSAGGDMDELLAVLGYKVRSDDMADVAEKLEQLEMVMGSAQEDGISQLSDTVHYNPSDLSGWVQSMLSELNTGDDMPSIDDPLLAPAESSSITSMSFSNSQRSRVFSDDSEYDLRAIPGVAAYPPAYSPSDSESTRKRLKTSIGSDSNGSSSGAVSDPTRPRVLVDSQETGVRLVHTLMACAEAVQQENLKLADALVKHVGLLAASQTGAMRKVATYFAEALARRIYRIYPQDCLDSSYSDILEMHFYETCPYLKFAHFTANQAILEAFATASRVHVIDFGLKQGMQWPALMQALALRPGGPPAFRLTGIGPPQPDNTDALQQVGWKLAQLAETIGVEFEFRGFVASSLADLTPSMLDIRPSEGEVVAVNSVFELHRLLARPGAVDKVLSSIKAMKPKIVTIVEQEANHNGPVFLDRFTEALHYYSNLFDSLEGSSGPSQDLVMSEVYLGRQICNVMACEGGDRVERHETLSQWRGRMDSAGFDPVHLGSNAFKQASMLLALFAGGDGYRVEENNGSLMLGWHTRPLIATSAWQLASATE

SEQ ID NO: 287 - protein, 329 aa, Arabidopsis thaliana
  misc_feature (167)..(273): Pfam Name: 2OG-FeII_Oxy Pfam Description: 2OG-Fe(II) oxygenase superfamily
  misc_feature (1)..(329): Bit score of 532.5 for HMM based on sequences of Figure 5
  misc_feature (1)..(329): in Figure 5
MAVLSKPVAIPKSGFSLIPVIDMSDPESKHALVKACEDFGFFKVINHGVSAELVSVLEHETVDFFSLPKSEKTQVAGYPFGYGNSKIGRNGDVGWVEYLLMNANHDSGSGPLFPSLLKSPGTFRNALEEYTTSVRKMTFDVLEKITDGLGIKPRNTLSKLVSDQNTDSILRLNHYPPCPLSNKKTNGGKNVIGFGEHTDPQIISVLRSNNTSGLQINLNDGSWISVPPDHTSFFFNVGDSLQVMTNGRFKSVRHRVLANCKKSRVSMIYFAGPSLTQRIAPLTCLIDNEDERLYEEFTWSEYKNSTYNSRLSDNRLQQFERKTIKNLLN

SEQ ID NO: 288 - protein, 332 aa, Vitis vinifera
  misc_feature (1)..(332): Public GI ID no. 147838135
  misc_feature (177)..(279): Pfam Name: 2OG-FeII_Oxy Pfam Description: 2OG-Fe(II) oxygenase superfamily
  misc_feature (1)..(332): Bit score of 603.8 for HMM based on sequences of Figure 5
  misc_feature (1)..(332): Functional Homolog Of SEQ ID NO. 287
  misc_feature (1)..(332): in Figure 5
MVVLSKPTIADFPPIINCKSTTLFPVIPTVDLSEPDSKHLVVKSCEEFGFFKVINHGIPLELISRLETEVIEFFSLSLSEKQKAGPPDPFGYGNRSIGPNGDVGWVEYLLLTMNQERNSQKLATIFGKYPEKLCSALNDYVLAVKKMACELLELMADGLRIKPRNVFSKLLMDEQSDSVFRLNHYPPCSELQASNGKNMIGFGEHTDPQIISVLRSNNTSGLQISLGNGSWISVPPDANSFFINVGDSLQVMTNGRFKSVRHRVLANSIKSRISMIYFGGPPLNEKIAPLPSLVEGKESLYKEFTWFEYKRSAYKSRLGDNRLSQFERTAAT

SEQ ID NO: 289 - DNA, 999 bp, Populus trichocarpa
  misc_feature (1)..(999): Ceres Annot ID no. 1466321
  misc_feature (1)..(999): Encodes the peptide sequence at SEQ ID NO. 290
atggtgctcgtgcccaagccagcacttcaacagttctcgtttataagaaacatcaaacccaccacattcttttctggaatccctctaatagacctctcaaaacccgactccaagcacctcctggtcaaggcatgtgaggaatttggatttttcaaggtagtcaaccatggcgtgcctttggaattcatttcgaagctggaatcggaagctgtcaagttcttctcattaccgctttctgagaaagaaaaagcaagccctcctaatccctttggctatggtaagaaaagcattggacaaaacggtgatgtgggttgggtagaataccttctcctgaccactaatcaagaatcagtttctcagagactctcttcagtttttggtgacaacccagaaaagtttcggtgtgctttgaatgattatgtatcagctgtgaagaaaatggcatgtgagattcttgaaatgatggctgatggtctaaagattcagaatagaaatgtgtttagtaaacttttgatggatgaacagagtgactctgtttttaggctaaatcactaccctccatgcccagagattcaagcattgaaagaccacaacatgattggatttggagagcacacagacccacagatcatttctgtgttaagatccaacaacacttctggcctgcaaatctctcttaatgatggaagctggatttcagtcccacctgacccgagctcatttttcatcaatgttggcgactcattacaggttatgactaatgggcggtttaaaagtgtaaggcacagagtcttggccaacagtataaaggctagaatttcaatgatttattttggtggaccacctttgagagagaaaatagctccattgccctcgctcatggaaggagaagaaagcttgtacagagaatttacatggttcgagtacaagagatctgcttacaactcaagattggccgataataagcttgtcctcttcgagaggataacagcctcgtaa

SEQ ID NO: 290 - protein, 332 aa, Populus trichocarpa
  misc_feature (1)..(332): Ceres Annot ID no. 1466321
  misc_feature (177)..(279): Pfam Name: 2OG-FeII_Oxy Pfam Description: 2OG-Fe(II) oxygenase superfamily
  misc_feature (1)..(332): Bit score of 620.0 for HMM based on sequences of Figure 5
  misc_feature (1)..(332): Functional Homolog Of SEQ ID NO. 287
  misc_feature (1)..(332): in Figure 5
MVLVPKPALQQFSFIRNIKPTTFFSGIPLIDLSKPDSKHLLVKACEEFGFFKVVNHGVPLEFISKLESEAVKFFSLPLSEKEKASPPNPFGYGKKSIGQNGDVGWVEYLLLTTNQESVSQRLSSVFGDNPEKFRCALNDYVSAVKKMACEILEMMADGLKIQNRNVFSKLLMDEQSDSVFRLNHYPPCPEIQALKDHNMIGFGEHTDPQIISVLRSNNTSGLQISLNDGSWISVPPDPSSFFINVGDSLQVMTNGRFKSVRHRVLANSIKARISMIYFGGPPLREKIAPLPSLMEGEESLYREFTWFEYKRSAYNSRLADNKLVLFERITAS

SEQ ID NO: 291 - protein, 332 aa, Gossypium hirsutum
  misc_feature (1)..(332): Public GI ID no. 340796359
  misc_feature (173)..(280): Pfam Name: 2OG-FeII_Oxy Pfam Description: 2OG-Fe(II) oxygenase superfamily
  misc_feature (1)..(332): Bit score of 594.8 for HMM based on sequences of Figure 5
  misc_feature (1)..(332): Functional Homolog Of SEQ ID NO. 287
  misc_feature (1)..(332): in Figure 5
MVILSKPAIEQFSCIRNKQAATLFPPLIPLVDLSKPDSRQQIIKACEEFGFFKVINHGVPMDFISRLESEATKFFSLPLSEKEKTGQPKPYGYGNKRIGPNGDVGWVEYLLLTTNQDPNLLGTENPESFRIALDNYMAAVKKMACEILEMIADGLKIQPRNVLSKLMMDEQSDSVFRLNHYPPCPEVVQSLNGTSSNVIGFGEHTDPQIISVLRSNNTSGLQISLRDGTWISVPPDQYSFFINVGDSLQVMTNGRFKSVKHRVLANSVKSRLSMIYFCGPPLSEKIAPLPSLMRGDQQSLYKEFTWFEYKKSAYSSRLADNRLMHFEKIVAS

SEQ ID NO: 292 - protein, 321 aa, Cucurbita maxima
  misc_feature (1)..(321): Public GI ID no. 27123665
  misc_feature (165)..(267): Pfam Name: 2OG-FeII_Oxy Pfam Description: 2OG-Fe(II) oxygenase superfamily
  misc_feature (1)..(321): Bit score of 591.5 for HMM based on sequences of Figure 5
  misc_feature (1)..(321): Functional Homolog Of SEQ ID NO. 287
  misc_feature (1)..(321): in Figure 5
MAAASSFSAAFYSGIPLIDLSAPDAKQLIVKACEELGFFKVVKHGVPMELISSLESESTKFFSLPLSEKQRAGPPSPFGYGNKQIGRNGDVGWVEYLLLNTHLESNSDGFLSMFGQDPQKLRSAVNDYISAVRNMAGEILELMAEGLKIQQRNVFSKLVMDEQSDSVFRVNHYPPCPDLQALKGTNMIGFGEHTDPQIISVLRSNNTSGFQISLADGNWISVPPDHSSFFINVGDSLQVMTNGRFKSVKHRVLTNSSKSRVSMIYFGGPPLSEKIAPLASLMQGEERSLYKEFTWFEYKRSAYNSRLADNRLVPFERIAAS

SEQ ID NO: 293 - protein, 339 aa, Jatropha curcas
  misc_feature (1)..(339): Public GI ID no. 254935149
  misc_feature (178)..(280): Pfam Name: 2OG-FeII_Oxy Pfam Description: 2OG-Fe(II) oxygenase superfamily
  misc_feature (1)..(339): Bit score of 601.8 for HMM based on sequences of Figure 5
  misc_feature (1)..(339): Functional Homolog Of SEQ ID NO. 287
  misc_feature (1)..(339): in Figure 5
MVVLSQTALDHYSSMKTCRPANGLFTGIPVIDLKDPEAKTRIVEACQEFGFFKLVNHGVPFEFMTRLEYLAMNFFNLPQSEKDKAGPPDPFGYGNKRIGPNGDVGWIEYLLLNTNPQVNCNKTLSIFQEYPQNFRSAVEDYILEVKRMTYEVLELMADGLGIEPRNVLSKLVSDEKSDSCFRLNYYPPCPELQALSGRNLIGFGEHTDPQIISVLRSNNTTGLQICLRDGTWVSVPPDQTSFFINIGDALQVMTNGRFRSVKHRVLADDMKSRISMIYFGGPPLSEKIAPFPSLLAEGEEGLYEQFTWYEYKSSAYKSRLADYRLGLFEKKMQAILANI

SEQ ID NO: 294 - protein, 322 aa, Marah macrocarpus
  misc_feature (1)..(322): Public GI ID no. 1666096
  misc_feature (166)..(269): Pfam Name: 2OG-FeII_Oxy Pfam Description: 2OG-Fe(II) oxygenase superfamily
  misc_feature (1)..(322): Bit score of 580.6 for HMM based on sequences of Figure 5
  misc_feature (1)..(322): Functional Homolog Of SEQ ID NO. 287
  misc_feature (1)..(322): in Figure 5
MVVLSKPEIQQLSSSSSSGVPLIDLSAPDAKHLIVKACEELGFFKVINHGVPMEFISTLESESTKFFSLPLSEKQRAGPPSPFGYGNKQIGRNGDVGWVEYLLLQSNSHAFLSIFGQDPQKLRSALNDYIWAVRNMACEIVELMAEGLKIQQRNALSKLLMGEESDSVFRVNHYPPCPEELQALEGTNMIGFGEHTDPQIISVLRSNNTSGLQISLPDANWISVPPDQTSFFINVGDSLQVMTNGRFKSVKHRVLTNSLKSRISMIYFGGPPLSEKIAPLPSLMKGEESLYKEFTWFEYKRSAYNSRLADNRLVHFERIAAS

SEQ ID NO: 295 - protein, 337 aa, Malus x domestica
  misc_feature (1)..(337): Public GI ID no. 255040359
  misc_feature (178)..(283): Pfam Name: 2OG-FeII_Oxy Pfam Description: 2OG-Fe(II) oxygenase superfamily
  misc_feature (1)..(337): Bit score of 608.1 for HMM based on sequences of Figure 5
  misc_feature (1)..(337): Functional Homolog Of SEQ ID NO. 287
  misc_feature (1)..(337): in Figure 5
MVFVTKSASEHFSYPRTSTKVSKLFSGIPLVDLTKPDSKQLIVNACEEYGFFKIINHGVPMDFITRLESEAIKFFSLPLSEKEKSGPPNPLGYGNKHIGKNGDVGWVEYLLLTTNTESISQRFLSVFGNNAEEFCSALNDYVSAVKKMTCEILELMSEGLKIQPRNVFSKLLMDEQSDSCFRLNHYPPCPELQGLSSAGARNVIGFGEHTDPQIISVLRSNNTSGLQISLRDGSWISVPPDQNSFFINVGDSLQVLTNGRFESVRHRVLANGLKSRLSMIYFGGPPLSEKIAPLQSVMNGEEESMYKEFTWFEYKKSAYSSRLADNRLGHFERIAAS

SEQ ID NO: 296 - protein, 337 aa, Lactuca sativa
  misc_feature (1)..(337): Public GI ID no. 9971227
  misc_feature (179)..(283): Pfam Name: 2OG-FeII_Oxy Pfam Description: 2OG-Fe(II) oxygenase superfamily
  misc_feature (1)..(337): Bit score of 597.8 for HMM based on sequences of Figure 5
  misc_feature (1)..(337): Functional Homolog Of SEQ ID NO. 287
  misc_feature (1)..(337): in Figure 5
MVALSKPSIEQFFMKPSKPNTNPLIFPTIPLIDLSKPESKQHLVKACQDFGFFKVVNHGVPTKFIKKLESEALKFFSSPLSTKEKAGPPDPFGYGNKRIGRNGDVGWVEYLLLNAKPESDYQRYLSVFEENPEIFQGVVNDYVTAVKKMACEILELLADEMKLQPRNVFSKLLMDEQSDSVFRVNHYLPCPEFQENERNGRKLVGFGEHTDPQIISVLRSNNTSGLEISLRDGSWMSVPADSDSFFINVGDSLQVMTNGRFKSVKHRVVANSTKSRVSMIYFGGPPLSEKIAPLPSLIQGEEDSLYKEFTWFEYKKSAFNTRLADNRLGLFEKITAT

SEQ ID NO: 297 - protein, 328 aa, Ipomoea nil
  misc_feature (1)..(328): Public GI ID no. 305677553
  misc_feature (176)..(274): Pfam Name: 2OG-FeII_Oxy Pfam Description: 2OG-Fe(II) oxygenase superfamily
  misc_feature (1)..(328): Bit score of 572.7 for HMM based on sequences of Figure 5
  misc_feature (1)..(328): Functional Homolog Of SEQ ID NO. 287
  misc_feature (1)..(328): in Figure 5
MVVLSKFSSVVKTCKPPALFPAGAVPLIDLSKPDSKHLLVKACEEFGFFKVVNHGVPSDFISTLESEALRFFSSPLSEKLKAGPPDPFGYGNKNVGACGDIGWVEYILLSTRHPQLNFQKFSSIMGLSPENLRTAVNEYVTAVKRMACEILELLADGLKIHPRNVFSKLLMDEQSDSVFRLNHYPPCPELGKNLIGFGEHTDPQIISVLRSNNASGLQIALNDGSWMSVPPDQHSFFINVGDSLQVMANGRFKSVRHRVLSNSAKSRLSMIYFGGPPLSEKIAPLPSLMEAEQDSLYREFTWFEFKKSAFSSRLAVNRLVPFEKIAAS

SEQ ID NO: 298 - protein, 332 aa, Nicotiana tabacum
  misc_feature (1)..(332): Public GI ID no. 46849529
  misc_feature (177)..(279): Pfam Name: 2OG-FeII_Oxy Pfam Description: 2OG-Fe(II) oxygenase superfamily
  misc_feature (1)..(332): Bit score of 615.4 for HMM based on sequences of Figure 5
  misc_feature (1)..(332): Functional Homolog Of SEQ ID NO. 287
  misc_feature (1)..(332): in Figure 5
MVVLTKPGIDHFPIVKNCKLSSFFNGVPLIDLSKPNSKNLIVKACEEFGFFKVINHSVPTEFITKLESEAIKFFSSPLSEKQKAGPADPFGYGNKKIGPNGDVGWVEYILLSTNSEFNYHKFASILGVNPETIRAAVNDYVSAVKKMACEILEMLAEGLNIHPRNVFSKLLMDEKSDSVFRLNHYPPCPEIQQFSDNNLIGFGEHTDPQIISVLRSNNTSGLQILLKNGHWISVPPDPNSFFINVGDSLQVMTNGRFKSVRHRVLANSVKSRLSMIYFGGPPLSEKIAPLASLMEGEESLYEEFTWFEYKKSAYKTRLADNRLVLFEKVAAS

SEQ ID NO: 299 - protein, 321 aa, Ricinus communis
  misc_feature (1)..(321): Public GI ID no. 255557309
  misc_feature (178)..(282): Pfam Name: 2OG-FeII_Oxy Pfam Description: 2OG-Fe(II) oxygenase superfamily
  misc_feature (1)..(321): Bit score of 587.0 for HMM based on sequences of Figure 5
  misc_feature (1)..(321): Functional Homolog Of SEQ ID NO. 287
  misc_feature (1)..(321): in Figure 5
MVVLSQTALDHFSLIKTCKPSSGLFNGIPVIDLTDPEAKNLLVQACQEFGFFKLVNHGVPIDFMTRLESLAINFFNLPQSEKDKAGPPDPFGYGNKRIGPNGDIGWIEYLLLNTNPQITSQTTLSIFKENPQIFRSAVEDYILAVKKMAYEVLELMADGLGIKPRNVLSRMLKDDKSDSCFRLNYYPPCPELQLQPLSGRNLVGFGEHTDPQIISVLRSNNTTGLQICLRDGTWVSVPPDQTSFFINVGDALQVMTNGRFKSVKHRVLADTMRSRISMIYFGGPPLSEKIAPLPSVLREGEESLYEQFTWCEYKRSAYKSR

SEQ ID NO: 300 - protein, 324 aa, Helianthus annuus
  misc_feature (1)..(324): Public GI ID no. 213032421
  misc_feature (166)..(270): Pfam Name: 2OG-FeII_Oxy Pfam Description: 2OG-Fe(II) oxygenase superfamily
  misc_feature (1)..(324): Bit score of 567.1 for HMM based on sequences of Figure 5
  misc_feature (1)..(324): Functional Homolog Of SEQ ID NO. 287
  misc_feature (1)..(324): in Figure 5
MVTVSKPIIEQFLVKPNTSPLVIPDIPLIDLSKPESKQHLVKACQDFGFFKVVNHGVPLKFINKLESEAVNFFNSPLATKEKFGPPDPFGYGNKCIGRNGDVGWVEYLLLNAKPESDYPENFQGIVNDYATSVKAMACEILELLADELKLQPRNVFSKLLKDEQSDSVFRVNHYPPCPEFQEKERNGSKLVGFGEHTDPQIISVLRSNNTSGLEISLRDGSWMSVPPDSESFFINVGDSLQVMTNGRFKSVKHRVVANGTKSRVSMIYFGGPPLSEKIAPLPSLMQGEEDSLYKEFTWFEYKKSAFNSRLSDNRLGLFEKIIAS

SEQ ID NO: 301 - protein, 335 aa, Solanum lycopersicum
  misc_feature (1)..(335): Public GI ID no. 126843239
  misc_feature (179)..(281): Pfam Name: 2OG-FeII_Oxy Pfam Description: 2OG-Fe(II) oxygenase superfamily
  misc_feature (1)..(335): Bit score of 604.3 for HMM based on sequences of Figure 5
  misc_feature (1)..(335): Functional Homolog Of SEQ ID NO. 287
  misc_feature (1)..(335): in Figure 5
MVVLTEPDNDHLPIINSNSCKSPSFFNDIPVIDLSKPDSKNLIVEACEEFGFFKVVNHDVPIEFISKLESEAIKFFSSPLSEKLKAGPADPFGYGNKQIGQSGDIGWVEYILLSTNSEFNYQKFASVLGVNPENIRAAVNDYVTAVKRMSCEILEKLAEGLKIHPTNVFSKLLKDEKSDSVFRLNHYPPCPDIQEFNAKNLIGFGEHTDPQIISVLRSNNTSGLQILLKNGNWFSVPPDQSSFFVNVGDSLQVMTNGRFKSVKHRVLTNSVKSRLSMIYFGGPPLSEKIAPLPSLMEGEESSLYKEFTWFEYKKSAFKSRLAQNRLTLFEKFGTS

SEQ ID NO: 302 - DNA, 1377 bp, Glycine max
  misc_feature (1)..(1377): Ceres Clone ID no. 572987
  misc_feature (1)..(1377): Encodes the peptide sequence at SEQ ID NO. 303
attcatgcattagcaatatttctcaatctctcttcttacccatttcctccccccctctttctcttttcttgttctgtttttattttcactgttctctgataacaacgttgttagttgtcaccatggttgttctgtctcagccagcattaaaccagtttttccttctgaaaacatgcaagcccacgcccttgttcgcggggattcctgtggtcgacctcacggaccccgatgccaagacccacatagtcaatgcctgcagggacttcggcttcttcaagctcgtgaaccacggtgttccgttacagttcatggccaatttggaaaacgaaaccctcgggttcttcaaaaaacctcaatccgagaaagacagggctggtccccctgacccttttggctacggcagcaagaggattggccctaacggcgatgtcggttgggtcgaatacctccttctcaacaccaaccctgatgtcatctcccccaagtcacagttcattttcagagaaggtcctcagaatttcagggcggtggtggaggaatacattagagcggtgaagaacatgtgctatgaggtgttggaattgatggctgagggattggggataacgcagaggaatgtgttgagtaggttgctgaaggatgagaagagtgattcttgcttcagacttaaccactacccgccatgcccggaggtgcaagcattgaacggaaggaatttggttggatttggagagcacacagacccacagataatttctgtcttgagatctaacagcacctcaggcctgcaaatctgtctcacagatggcacttgggtttctgtcccacctgatcaaacttcctttttcatcaatgttggtgacactcttcaggtaatgactaatgggaggtttaaaagtgtaaagcatagagttttggctgacccaaccaagtcaaggttgtcaatgatctactttggaggaccacccttgtgtgaaaagatagcacctttaccttcactcatgttaaaaggagaagagagtttctacaaagagttcacatggtgggaatacaagaaggctgcgtacgcgtcaaggctagcggataatagactcggcccttttgagaaatctgctgctgattaaggaggcaaagtgtgtcaaaattctactactcaattttggcacgtgttgttaggccaacttttttattttttattttttttgggtgtgtgtatctaggttccaaacagttgactttacttgagatatatagaaaatgaataggttgcttatgcacttccttttaatccttgttctttttcttgtttgattgaagtgtaatagtcactactgcccttctattatcaatgaaacgcaactctagtcacagcttttc

SEQ ID NO: 303 - protein, 333 aa, Glycine max
  misc_feature (1)..(333): Ceres Clone ID no. 572987
  misc_feature (177)..(279): Pfam Name: 2OG-FeII_Oxy Pfam Description: 2OG-Fe(II) oxygenase superfamily
  misc_feature (1)..(333): Bit score of 598.7 for HMM based on sequences of Figure 5
  misc_feature (1)..(333): Functional Homolog Of SEQ ID NO. 287
  misc_feature (1)..(333): in Figure 5
MVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAAD

SEQ ID NO: 304 - DNA, 999 bp, Populus trichocarpa
  misc_feature (1)..(999): Ceres Annot ID no. 1501920
  misc_feature (1)..(999): Encodes the peptide sequence at SEQ ID NO. 305
atggtagtactttcccaactagctctagaacctttctcagttatcaaaacatgcaagcctataggcttgttttccgagatacccgttatagacttgacagaccctcatgccaagactctcataatcaaggcctgtgaagagtttggattcttcaagctggtaaatcatggagttccaatggaagtcatgaccaaattggaagctcttgctaccaacttctttaacctcccccagcctgagaaagacaaggctggacctcctaacccttttggctacggaaacaagaaaattggccctaatggtgatgttggttgggttgaatatctcctccttaacaccaaccctcaaatctcctcccaaaaaacgtccatttttcaggaaaacccacagattttccgctctgctgttgaagattacatactggcagtgaagagaatggcttttgaagtattggaattgatggctgatgggctggagattgagtcaaggaatgtgttcagtaggctgttgagggatgataagagtgattcatgtttcaggctaaaccactacccaccatgctcagagctgcaagcattgagtggtggaaatttgattgggtttggcgagcacacagacccacagataatatctgttctaagatctaacaacacaagtggcctgcaaatttgtctgaaagagggaacttgggtttcagtcccccctgatcagacctcttttttcatcaatgttggtgatgccttgcaggtgatgacaaatggaaggtttaggagtgtcaagcacagggttttggctgatcccctgaaaccaaggatttccatgattttcttcggtggtccacctttaagtgaaaagatagcacctttaccctccttgatggcagaaagaggaggaagcttatacaaggagttcacatggtttgaatacaaaaggtccgcatacaagtcaaggctagctgattacagacttgggctatttgagaaaactgcaggccaatga

SEQ ID NO: 305 - protein, 332 aa, Populus trichocarpa
  misc_feature (1)..(332): Ceres Annot ID no. 1501920
  misc_feature (176)..(278): Pfam Name: 2OG-FeII_Oxy Pfam Description: 2OG-Fe(II) oxygenase superfamily
  misc_feature (1)..(332): Bit score of 597.0 for HMM based on sequences of Figure 5
  misc_feature (1)..(332): Functional Homolog Of SEQ ID NO. 287
  misc_feature (1)..(332): in Figure 5
MVVLSQLALEPFSVIKTCKPIGLFSEIPVIDLTDPHAKTLIIKACEEFGFFKLVNHGVPMEVMTKLEALATNFFNLPQPEKDKAGPPNPFGYGNKKIGPNGDVGWVEYLLLNTNPQISSQKTSIFQENPQIFRSAVEDYILAVKRMAFEVLELMADGLEIESRNVFSRLLRDDKSDSCFRLNHYPPCSELQALSGGNLIGFGEHTDPQIISVLRSNNTSGLQICLKEGTWVSVPPDQTSFFINVGDALQVMTNGRFRSVKHRVLADPLKPRISMIFFGGPPLSEKIAPLPSLMAERGGSLYKEFTWFEYKRSAYKSRLADYRLGLFEKTAGQ

SEQ ID NO: 306 - protein, 329 aa, Elaeis guineensis
  misc_feature (1)..(329): Public GI ID no. 192910888
  misc_feature (178)..(279): Pfam Name: 2OG-FeII_Oxy Pfam Description: 2OG-Fe(II) oxygenase superfamily
  misc_feature (1)..(329): Bit score of 550.7 for HMM based on sequences of Figure 5
  misc_feature (1)..(329): Functional Homolog Of SEQ ID NO. 287
  misc_feature (1)..(329): in Figure 5
MVVLTNTTLERITLPVAPKPSTYFSGIPVINLAQPGSETLLVRACEELGFFKVTNHGIPMELIARLEEEAVKFFSLAQVEKERAGTGNPFGYGNKTIGHTGDVGWVEYLLFDVTSKPMSHTALAFLEEPSASSLCSALNEYVSAMRKLVCEVLELMAEGLRVQPRNILSKLVMDEESDSILRLNHYPPCPHLPELDSSLTGFGEHTDPQIISILRSNNTSGLQIYLRDGSWVTVPPDQDSFFINVGDSLQVLTNGRFRSVKHRVLAHGLKSRVSMIYFGGPPSGERLAPLPLLMGEGEESLYREFTWCEYKSFAHGTRLTDNRLGQFQR

SEQ ID NO: 307 - DNA, 1477 bp, Triticum aestivum
  misc_feature (1)..(1477): Ceres Clone ID no. 704889
  misc_feature (1)..(1477): Encodes the peptide sequence at SEQ ID NO. 308
acactccaactcagtggcaacagcatctcccctgttccgcccgcccgctcgcctctgtttcttttctttctttccacagcggctctgctccgctcctcacctccctcgatcgcacataccatatttggtagctcagcacagccatggtggttcttgccagcacgcccgccgtcgatcacatcccgctcctcaggtcccccgaccccggggactacttctccggcatgccggttgtcgacctctccagccctggcgcgccgcgggccatcgccgacgcctgcgagcgcttcgggttcttcaagctcgtcaaccacggggtgccagcggacacgatggacaggctcgagtcagaggccgtcaggttcttctcgctgccgcaggccgacaaggaccgctccggcccggcctacccgttcggctacggcagcaagcgcatcgggctcaatggcgacatgggctggctcgagtacctcctcctcgccgtcgagtccgcgtcgctctccggcgcctgcaccgtcccgtcctgcgcgctcttccgggcggcgctgaacgagtacatcgcggcggtgcggaaggtggcggtgcgggtgatggaggcgatggcggaggggctgggcattgcgcccgttgacgcgctgagcgcgatggtgacggcgggggggagcgaccaggtgttccgggtgaaccactacccgccgtgccacgcgctgcaagggctgggctgcagcgccacaggcttcggcgagcacaccgacccgcagctcatctccgtgctgcgctccaacggcacgtccggcctgcagatcgcgctccagaacgggcagtgggtgtccgtgccctcggaccgcgacgccttcttcgtcaacgtcggcgactcgttgcaggtgctgaccaacgggaggttcaagagcgtgaagcacagggtggtggccaacagcctaaagtctagggtttccatgatctactttggagggccagcgatgacacagaggattgcaccattgccgcagctgctgggcgcgggagagcagagcctgtacaaggacttcacatggggcgagtacaagaaggctgcctacaactcgaggctcggggacaacaggctggctcagttccacaggtagcctcgcctgccgcctgggcctgctcaaggagcagcttttaccaagccagctagctctagcttagctagctctgccgtggcttgtatttcccacacgatcgatgaagatcaagagggggggaagctactactagaaaagaaaaagaaacagggctaaaagaagatgatttcaagattcacatgcagtagtagagctgcggaggtagctagatcctttttgcgtgtgcgcgtgcgtgtgtgttcatagttgctaaaactcgcctttcctattcgggaatgccggacgaacgatgaacagataagttaacttgatgaatagttagtgtgaaccagatacagcagaggattggcatc

SEQ ID NO: 308 - protein, 326 aa, Triticum aestivum
  misc_feature (1)..(326): Ceres Clone ID no. 704889
  misc_feature (175)..(276): Pfam Name: 2OG-FeII_Oxy Pfam Description: 2OG-Fe(II) oxygenase superfamily
  misc_feature (1)..(326): Bit score of 548.8 for HMM based on sequences of Figure 5
  misc_feature (1)..(326): Functional Homolog Of SEQ ID NO. 287
  misc_feature (1)..(326): in Figure 5
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVESASLSGACTVPSCALFRAALNEYIAAVRKVAVRVMEAMAEGLGIAPVDALSAMVTAGGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNRLAQFHR

SEQ ID NO: 309 - protein, 326 aa, Hordeum vulgare
  misc_feature (1)..(326): Public GI ID no. 326511994
  misc_feature (1)..(326): Hordeum vulgare subsp. vulgare
  misc_feature (175)..(276): Pfam Name: 2OG-FeII_Oxy Pfam Description: 2OG-Fe(II) oxygenase superfamily
  misc_feature (1)..(326): Bit score of 544.4 for HMM based on sequences of Figure 5
  misc_feature (1)..(326): Functional Homolog Of SEQ ID NO. 287
  misc_feature (1)..(326): in Figure 5
MVVLAGTPAVDHIPLLRSPDPGDNFSGMPVVDLSRPGAPRAIADACERFGFFKLVNHGVALDAMDRLESEAVRFFSLPQADKDRSGPAYPFGYGSKRIGLNGDMGWLEYLLLAVDSASLPAASAVPSCALFRAALNEYIAAVRKVAVRVMEAMAEGLGIAQADALSAMVAAEGSDQVFRVNHYPPCHALQGLGCSATGFGEHTDPQLISVLRSNGTSGLQIALQSGHWVSVPSDRDAFFVNVGDSLQVLTNRRFKSVKHRVVANSLKSRVSMIYFGGPALTQRIAPLPQLLREGEQSLYKDFTWGEYKKAAYNSRLGDNRLAHFHR

SEQ ID NO: 310 - protein, 327 aa, Oryza sativa
  misc_feature (1)..(327): Public GI ID no. 125527760
  misc_feature (1)..(327): Oryza sativa Indica Group
  misc_feature (175)..(276): Pfam Name: 2OG-FeII_Oxy Pfam Description: 2OG-Fe(II) oxygenase superfamily
  misc_feature (1)..(327): Bit score of 547.4 for HMM based on sequences of Figure 5
  misc_feature (1)..(327): Functional Homolog Of SEQ ID NO. 287
  misc_feature (1)..(327): in Figure 5
MVVLAGPPAVDHIPLLRSPDPGDVFSGVPVVDLGSPGAARAVVDACERYGFFKVVNHGVATDTMDKAESEAVRFFSQTQPDKDRSGPAYPFGYGSKRIGFNGDMGWLEYLLLALDDASLADACTVPSCAVFRAALNEYISGVRKLAVRVMEAMSEGLGIAQADALSALVTAEGSDQVFRVNHYPPCRALQGLGCSVTGFGEHTDPQLVSVLRSNGTSGLQIALRDGQWVSVPSDRDSFFVNVGDSLQVLTNGRFKSVKHRVVANSLKSRVSFIYFGGPPLAQRIAPLPQLLGEGEQSLYKEFTWDEYKKAAYKSRLGDNRLAQFEKK

SEQ ID NO: 311 - protein, 341 aa, Lolium temulentum
  misc_feature (1)..(341): Public GI ID no. 84180617
  misc_feature (178)..(282): Pfam Name: 2OG-FeII_Oxy Pfam Description: 2OG-Fe(II) oxygenase superfamily
  misc_feature (1)..(341): Bit score of 519.0 for HMM based on sequences of Figure 5
  misc_feature (1)..(341): Functional Homolog Of SEQ ID NO. 287
  misc_feature (1)..(341): in Figure 5
MVVLAKPAALEQISLLRTPEPWETFSGVPAVDLSGPDAAGDVVRACEQFGFFSVVNHGVPAGVVDRLEAEAVRFFGSSPAVKDASAPAGADPFGYGSKRIGRNGDMGWLEYLLLAIDRDALSEKASRAATSTALRDAINEYVVAMRGLARTVLEMVADGLGVSPRGALADMVTGDASDQVFRLNHYPPCPLLQGLPPSCSVTGFGEHTDPQLVSILHSNGTAGLQVALHDGRWVSVPPNRDAFFVNVGDSLQVLTNGRLKSVRHRVVAGSGLKSRVSMIYFGGPPLAQRIAPLPQLLAGLPLYREFTWGEYKKAAYRSRLGDNRLAPFEEPPVAAGHHHWS

SEQ ID NO: 312 - DNA, 1005 bp, Sorghum bicolor
  misc_feature (1)..(1005): Ceres Annot ID no. 8733572
  misc_feature (1)..(1005): Encodes the peptide sequence at SEQ ID NO. 313
atggtcgtcctcgcgaagccaccgccggcgctcgaccaaatctccctgcttcgatgcccgcagcccggggacgcggcgtccttcttcggcgtgccggccgtcgacctgtccagccccggcgcggctctggccgtggtggacgcgtgcgagcggttcggcttcttcaaggtggtgaaccacggcgtgccaacgggcgtcgtggatcggctggaggccgaggccgtcaggttcttcgcgtcgccgcaggcggacaaggacgcgtgcggccccgccaacccgctcgggtacgggaacaagcgcatcggccgcaatggcgacatggggtggctcgagtacctcctcctcgccctcgacggcgcctcctcggtgtccaaggcctcccctgtcccgtcatcctcgctgcgggacgcggtaaaccagtacgtcgccgccgtgcggggactggcgacgtcggtgctggaggcggtggcggaggggctgggcgtggcgccgagggacgcgctgagcggcatggtgacggacgcggcgagcgaccaggtgttccggatcaaccactacccggcgtgcccgctgctgcagcgcctgccggactcgtgcggcgtcaccggcttcggcgagcacacggacccgcagctggtgtccgtgctgcgctccaacggcacggccggcctgcaggtcgcgctccacgacgacggggggcggtgggtgcccgtgccgcccgaccgcgacgccttcttcgtcatcgtcggcgactcgctgcaggtcctgacgaatgggaggctgaaaagtgtgcggcaccgggtggtggccaacagcctgaagccgcgggtgtccatgatctacttcgcgggaccggcgccggcgcagcggatcgcgccattgccgcaggtgctggggcacggcgagcagagcttgtacagggacttcacatggggcgactacaagaaggctgcctaccgatcgcgcctcggagacaaccgcctggaccccttccgcatccagtga

SEQ ID NO: 313 - protein, 334 aa, Sorghum bicolor
  misc_feature (1)..(334): Ceres Annot ID no. 8733572
  misc_feature (178)..(285): Pfam Name: 2OG-FeII_Oxy Pfam Description: 2OG-Fe(II) oxygenase superfamily
  misc_feature (1)..(334): Bit score of 520.1 for HMM based on sequences of Figure 5
  misc_feature (1)..(334): Functional Homolog Of SEQ ID NO. 287
  misc_feature (1)..(334): in Figure 5
MVVLAKPPPALDQISLLRCPQPGDAASFFGVPAVDLSSPGAALAVVDACERFGFFKVVNHGVPTGVVDRLEAEAVRFFASPQADKDACGPANPLGYGNKRIGRNGDMGWLEYLLLALDGASSVSKASPVPSSSLRDAVNQYVAAVRGLATSVLEAVAEGLGVAPRDALSGMVTDAASDQVFRINHYPACPLLQRLPDSCGVTGFGEHTDPQLVSVLRSNGTAGLQVALHDDGGRWVPVPPDRDAFFVIVGDSLQVLTNGRLKSVRHRVVANSLKPRVSMIYFAGPAPAQRIAPLPQVLGHGEQSLYRDFTWGDYKKAAYRSRLGDNRLDPFRIQ

SEQ ID NO: 314 - protein, 317 aa, Daucus carota
  misc_feature (1)..(317): Public GI ID no. 50428335
  misc_feature (171)..(265): Pfam Name: 2OG-FeII_Oxy Pfam Description: 2OG-Fe(II) oxygenase superfamily
  misc_feature (1)..(317): Bit score of 508.1 for HMM based on sequences of Figure 5
  misc_feature (1)..(317): Functional Homolog Of SEQ ID NO. 287
  misc_feature (1)..(317): in Figure 5
MVVLSQPVEHVNFPAIKSCNGNSTHIPVVDLSNPDAKTQIVNACQEFGFFKVINHGVPMEIVTKLEAQALSFFKQPQNHKNKAAPFGYGNKNIGRKGDTGWVEYLLFGTDTQLISQNSLTILPNDFWAMVNKYLSAVKNLACEILKLMAEELNLQPKNVLSRLLSDKKSDSFFRINHYPASDRNELGFGEHTDPQIISVIRSNNASGLEIALKDGTWTQVPADPSSFFITVDDCLQVMTNGRFRSVKHRVITESLKERLSMIYFGGPPLSEKIAPSTSLMQGEESLYKEFTWGEYKKAAFNTKLAFNRISFFEKSPS

SEQ ID NO: 315 - protein, 378 aa, Oryza sativa
  misc_feature (1)..(378): Public GI ID no. 46576018
  misc_feature (1)..(378): Oryza sativa Japonica Group
  misc_feature (112)..(210): Pfam Name: 2OG-FeII_Oxy Pfam Description: 2OG-Fe(II) oxygenase superfamily
  misc_feature (1)..(378): Bit score of 235.5 for HMM based on sequences of Figure 5
  misc_feature (1)..(378): Functional Homolog Of SEQ ID NO. 287
MAQPEKEAAAAAAAAAVPGSPFGYGSKRIGCNGDLGWVEYLLLGVAAAAAAPLPAHGEASPSPSYGSFRDILNEYVVAVRAMMWEVLKLMAEGLGLKEKDALVRLVSHEESDSVLRVNHYPPHPELKQQGHGRLTGFGEHTDPQIISVLRSNDTSGLEISLRDGSWASVPPDRKSFFVNVGDVLQPGGRIKLEELQGFLHAVSLRSRATREATRSRPAAGLLSLASPTSPPPEQPPAKPDGGKDGGGGAFYPLQHPAVGAPTGNRRRGGDASRRLRRRRRPEAAEPASLLADLAPSQPDRDEVAPAALHQDEALAGAVVAPAEKAAGWGSRGAGGGDVAGGGDEAASLGAAGSGSPRPDPTPAAGPRRRPAPGRRRRR

SEQ ID NO: 316 - protein, 321 aa, Arabidopsis thaliana
  misc_feature (1)..(321): Public GI ID no. 15221037
  misc_feature (158)..(269): Pfam Name: 2OG-FeII_Oxy Pfam Description: 2OG-Fe(II) oxygenase superfamily
  misc_feature (1)..(321): Bit score of 352.9 for HMM based on sequences of Figure 5
  misc_feature (1)..(321): Functional Homolog Of SEQ ID NO. 287
MVKGSQKIVAVDQDIPIIDMSQERSQVSMQIVKACESLGFFKVINHGVDQTTISRMEQESINFFAKPAHEKKSVRPVNQPFRYGFRDIGLNGDSGEVEYLLFHTNDPAFRSQLSFSSAVNCYIEAVKQLAREILDLTAEGLHVPPHSFSRLISSVDSDSVLRVNHYPPSDQFFGEANLSDQSVSLTRVGFGEHTDPQILTVLRSNGVGGLQVSNSDGMWVSVSPDPSAFCVNVGDLLQVMTNGRFISVRHRALTYGEESRLSTAYFAGPPLQAKIGPLSAMVMTMNQPRLYQTFTWGEYKKRAYSLRLEDSRLDMFRTCKD

SEQ ID NO: 317 - protein, 312 aa, Physcomitrella patens
  misc_feature (1)..(312): Public GI ID no. 168044732
  misc_feature (1)..(312): Physcomitrella patens subsp. patens
  misc_feature (164)..(261): Pfam Name: 2OG-FeII_Oxy Pfam Description: 2OG-Fe(II) oxygenase superfamily
  misc_feature (1)..(312): Bit score of 182.2 for HMM based on sequences of Figure 5
  misc_feature (1)..(312): Functional Homolog Of SEQ ID NO. 287
MFSASSHTLPTIDLHSAHLGEQVVSACRDWGFFQVHNHGIPPELLNRLRAHAHCFFELPLQQKERVAACKSNNFYGYGVSKARTYFPNDWMEAFDMEWTPISRVRRHVQQVGLAHARYEDFCGAVEDYASKTEKLAVRLTEQVALGLGLDATAFSRHFEESTTSTVRMNYYPPHPNPSRTLGISPHSDFNIFTILLHDTVPGLQVLKDGKWITVKPSPDTLVINVGDTFQAWCNGRIKSVMHRALVNATEPRLTVVHFFGPHPDTMIVPPAALVDNDNPLRYRSFAYKEMVEQIMHIRGKSVFESPLTSFLL

SEQ ID NO: 318 - DNA, 1101 bp, Sorghum bicolor
  misc_feature (1)..(1101): Ceres Annot ID no. 8734027
  misc_feature (1)..(1101): Encodes the peptide sequence at SEQ ID NO. 319
atggtggcgatcacggcgccgagctcgatcgagcagatcccgctggtgcagtgtcccagggccaatgcgagcgcggccatcccgtgcgtggacctgtcggcgccgggcgcggccgcggcggtggccgacgcgtgccgcggcgtgggcttcttcagggcgaccaaccacggcgtgccggcgcgcgtggtcgaggcgctggaggcccgcgcgatggcgttcttcgcgctgcccgcccaggagaagctggacatgtccggcgccgctcgccccatggggtacggcagcaagcgcatcggctccaacggcgacgtcgggtggctcgagtacctcctcctctccgtcagcgccaacaccgtcaagatctcctccctgccgccctcgctccgagcggcattggaggagtacacggcggcggtgagggaggtgtgcgggcgggtgctggagctcatagcggaggggctgggcgtggacaggtccctgctgcgtgcgatggtggtggggcgggaaggcagcgacgagctggtgcgggtgaaccactacccgccctgcccgctgctgccgccggtggactgcggcgtgacggggttcggggagcacacggacccgcagatcatctccgtgctcaggtccaacagcacggctggcctgcagatcaagctccgggacggcaggtgggtccccgtgccccccgccccggaatccttcttcgtcaacgtcggagacgcgctgcaggtcctgacgaacgggcggttcaagagcgtgaagcaccgggtggtggcgccggaaggggcgcagtcacggctgtcggtgatctacttcggcgggccggcgccgtcgcagcggatcgcgccgctgccggaggtgatgcgggacggggagcagagcctgtaccgggagttcacctgggccgagtacaagaccgccatgtacaagacccgcctcgccgaccaccgcctcggccccttcgagctgcgcgccaccaacaccaacagctgcgtgccgccgccgccgccgcccagcgtcgacccgtactgcaacggcagcggcatctgcatgccgcagccgccgccgcagcagcagcaggtggcagaggtgcactag

SEQ ID NO: 319 - protein, 366 aa, Sorghum bicolor
  misc_feature (1)..(366): Ceres Annot ID no. 8734027
  misc_feature (172)..(274): Pfam Name: 2OG-FeII_Oxy Pfam Description: 2OG-Fe(II) oxygenase superfamily
  misc_feature (1)..(366): Bit score of 435.9 for HMM based on sequences of Figure 5
  misc_feature (1)..(366): Functional Homolog Of SEQ ID NO. 287
MVAITAPSSIEQIPLVQCPRANASAAIPCVDLSAPGAAAAVADACRGVGFFRATNHGVPARVVEALEARAMAFFALPAQEKLDMSGAARPMGYGSKRIGSNGDVGWLEYLLLSVSANTVKISSLPPSLRAALEEYTAAVREVCGRVLELIAEGLGVDRSLLRAMVVGREGSDELVRVNHYPPCPLLPPVDCGVTGFGEHTDPQIISVLRSNSTAGLQIKLRDGRWVPVPPAPESFFVNVGDALQVLTNGRFKSVKHRVVAPEGAQSRLSVIYFGGPAPSQRIAPLPEVMRDGEQSLYREFTWAEYKTAMYKTRLADHRLGPFELRATNTNSCVPPPPPPSVDPYCNGSGICMPQPPPQQQQVAEVH

SEQ ID NO: 320 - protein, 355 aa, Vigna angularis
  misc_feature (1)..(355): Public GI ID no. 67077820
  misc_feature (1)..(355): Public GI ID no. 67077820
  misc_feature (172)..(294): Pfam Name: 2OG-FeII_Oxy Pfam Description: 2OG-Fe(II) oxygenase superfamily
  misc_feature (1)..(355): Bit score of 397.6 for HMM based on sequences of Figure 5
  misc_feature (1)..(355): Functional Homolog Of SEQ ID NO. 287
MVAPCPTSMMVRTKKTKAVGVPTIDLSLERSKLSETVVKACEEYGFFKVVNHSVAKEVISRLEEEGTAFFSKTTSEKRQAGPANPFGYGCRNIGPNGDMGHLEYLLLHTNPLSVSERSQTIASDPTKFSSAVNDYIEAAKGLTCEILDLVAEGLWVQDNFSLSNLIKDVHSDSLLRINQYPPVSLTGNKNSDTSKLEPHQLHNQNNNNNNNNIGFGEHSDPQILTIMRSNNVDGLQISTHDGLWIPVPPDPNQFFVMVGDALQVLTNGRFRSVRHRVLTNTTKARMSMMYFAAPPLNWWITPLPKMVTPLNPTLFKPFTWAQYKQAAYSLRLGDTRLDLFKIQRQRDTHLASASP

SEQ ID NO: 321 - protein, 332 aa, Vigna angularis
  misc_feature (1)..(332): Public GI ID no. 67077812
  misc_feature (177)..(278): Pfam Name: 2OG-FeII_Oxy Pfam Description: 2OG-Fe(II) oxygenase superfamily
  misc_feature (1)..(332): Bit score of 582.2 for HMM based on sequences of Figure 5
  misc_feature (1)..(332): Functional Homolog Of SEQ ID NO. 287
MVVLSQPALNQFLLLKPCKSTPLFTGIPVVDFTHPDAKNLIVEACRDYGFFKLVNHGVPLELVANLENEALRFFKKSQSEKDRAGPPDPFGYGSKGIGPNGDVGWVEYLLLNTNPEVISPKSLSIFRESPHHFRAVVENYITAVKNMCYAVLELMAEGLGIAQRNTLSRLLKDEKSDSCFRMNHYPPCPEVPALNRNLVGFGEHTDPQIISVLRSNSTSGLQICLADGTWVSVPPDQTSFFINVGDALQVMTNGRFKSVKHRVLADTTKSRLSMIYFGGPALSEKIAPLPSVMVKGEESLYKEFTWWEYKKAAYTSRLADNRLAPFEKSATD

SEQ ID NO: 322 - protein, 373 aa, Zea mays
  misc_feature (1)..(373): Public GI ID no. 212721130
  misc_feature (176)..(282): Pfam Name: 2OG-FeII_Oxy Pfam Description: 2OG-Fe(II) oxygenase superfamily
  misc_feature (1)..(373): Bit score of 421.7 for HMM based on sequences of Figure 5
  misc_feature (1)..(373): Functional Homolog Of SEQ ID NO. 287
MVAITAPSSIEQIPLMRCPRANAVQQAGAAVPCVDLSAPGAGAAVADACRSVGFFRATNHGVPARVADALEARAMAFFALPAQEKLDMSGAARPLGYGSKSIGANGDVGWLEYLLLSVSANTVKISSLPPSLRAALEEYTAALREVCGRVLELIAEGLGVERSLLRAMVVGREGSDEVVRVNHYPPCPLLPPVDCGVTGFGEHTDPQIISVLWSNRTAGLQIKLRDGRWVPVPPTPESLFVNVGDSLQVLTNGRLRSVKHRVVAPAPAPDGARSRLSVIYFGGPAPSQRIAPLPQVMRDGEQSLYREFTWAEYKRAMYKTRLADHRLGPFELRASTNGGNRPGEPAAGSADPAHCSGGSACGMPQPQQVARVH

SEQ ID NO: 323 - protein, 342 aa, Hordeum vulgare
  misc_feature (1)..(342): Public GI ID no. 49065954
  misc_feature (1)..(342): Hordeum vulgare subsp. vulgare
  misc_feature (174)..(280): Pfam Name: 2OG-FeII_Oxy Pfam Description: 2OG-Fe(II) oxygenase superfamily
  misc_feature (1)..(342): Bit score of 519.9 for HMM based on sequences of Figure 5
  misc_feature (1)..(342): Functional Homolog Of SEQ ID NO. 287
MVVLAKPAALEQIALMRTPEPWESFSGVPAVDLSSPGAAADVVRACERFGFFSVVNHGVPAGVVDRLEAEAVRFFASTQAEKDASGPADPFGYGSKRIGRNGDMGWVEYLLLAIDRDTLSKASPAPSSALREAINAYVSAMRGLARTVLEMVAEGLGVSPRGALADMVTGEASDQVFRVNHYPPCPLLQGLPPNCSVTGFGEHTDPQLVSILHSNGTAGLQVALHDGRWVSVPPNRDAFFVNVGDSLQVLTNGRLRSVRHRVVAGNGLKSRVSMIYFAGPPLAQRIAPLQQLLAGTQSLPLYRDFTWGEYKKAAYRSRLGDNRLAPFETPLVAMPHAAHHRS

SEQ ID NO: 324 - protein, 319 aa, Torenia fournieri
  misc_feature (1)..(319): Public GI ID no. 320462780
  misc_feature (161)..(264): Pfam Name: 2OG-FeII_Oxy Pfam Description: 2OG-Fe(II) oxygenase superfamily
  misc_feature (1)..(319): Bit score of 505.6 for HMM based on sequences of Figure 5
  misc_feature (1)..(319): Functional Homolog Of SEQ ID NO. 287
MAIEQFFTCPLIELSEPDSKPQLVKACEEFGFFKVINHRVPIHVMTRLGHEAVRFFSLPLADKLRTGPPDPFGYGNKKIGSNGDVGSVEYLLLTTNYSNQDYQRFSSTFGEAAAENFRCVLNEYVSSVRKMACEILEMVADELKIQPRNVFSKLLMDEESDSVFRLNHYPPSDDESREKNLIGFGEHTDPQIISVLRSNNTSGLQISLRDGKWISIPPDETSFFVNVGDSLQVMTNGRLKSVRHRVVANNNNKSFGRLSMIYFGGPPLSEKIAPLPSLVKAGESESLYREFTWFDFKKSVVYNSRLADDRLRRVSLRQS

SEQ ID NO: 325 - protein, 321 aa, Arabidopsis lyrata
  misc_feature (1)..(321): Public GI ID no. 297847044
  misc_feature (1)..(321): Arabidopsis lyrata subsp. lyrata
  misc_feature (158)..(269): Pfam Name: 2OG-FeII_Oxy Pfam Description: 2OG-Fe(II) oxygenase superfamily
  misc_feature (1)..(321): Bit score of 349.2 for HMM based on sequences of Figure 5
  misc_feature (1)..(321): Functional Homolog Of SEQ ID NO. 287
MVKGSQKIVAVDQDIPIIDMSQERSQVSMQIVKACETLGFFKVINHGVDQTTISRMEQESINFFAKPAHEKKSVRPVNQPFRYGFRDIGLNGDSGEVEYLLFHTNDPAFRSQLSFSSTVNCYIEAVKQLAREILDLTAEGLHVPPHSFSRLISSVDSDSVLRVNHYPPSDQFFGGANLSDKSVSLTRVGFGEHTDPQILTVLRSNGVGGLQVSNSDGMWVSVSPDPSAFCVNVGDLLQVMTNGRFISVRHRALTYGEESRLSTAYFAGPPLQAKIGPLSAMVTMMNQPRLYQTFTWGEYKKLAYSLRLEDSRLDMFRTCKD

SEQ ID NO: 326 - protein, 336 aa, Chrysanthemum x morifolium
  misc_feature (1)..(336): Public GI ID no. 190192216
  misc_feature (177)..(281): Pfam Name: 2OG-FeII_Oxy Pfam Description: 2OG-Fe(II) oxygenase superfamily
  misc_feature (1)..(336): Bit score of 555.5 for HMM based on sequences of Figure 5
  misc_feature (1)..(336): Functional Homolog Of SEQ ID NO. 287
MVVLTKPTLEQLIMKTKPVNLLTLAQIPIVDLSSHDSKHQIVNACQEFGFFKVVNHGISMNLINKLESQAMKFFSSPQDIKDKAGPADPFGYGNKKIGTNGDVGWVEYLLLNAKPETDIEKLVSVFGEHSEVFQHVLNDYLTSVKKMGCGILELMAEGLELESKNVFSKLLMDDKSDSVFRLNYYPPYPDVQEDEINVRNLIGFGEHTDPQIISVLRSNNTSGLEIALKDGSWVSVPADSEAFFINVGDSLQVMTNGRFKSIKHRVVANSKKSRMSMIYFGGPPLNEKIAPLSSLIGREEDSLYKEFTWFEYKNSAFSSSLSDNRLGLFEKLSSRI

SEQ ID NO: 327 - DNA, 996 bp, Populus trichocarpa
  misc_feature (1)..(996): Ceres Annot ID no. 1497828
  misc_feature (1)..(996): Encodes the peptide sequence at SEQ ID NO. 328
atggtagttccttctccaactccagcacgaaccagaaaaacgaaggcctttggaattcctactgttgatctctctcttgataggtcaaacgtatcgaaactgatcgtaagggcatgtgaagaatatggattcttcaaagttacgaatcatggggtcagtaaggaggtcgtaaccagaatggaggaggaagctgctcattttttctcaaaaccagccacggaaaagcaccgagctggacctgctagtccttttggctatggttgcaaaaatattggctacaatggagacatgggcgagcttgaatatcttctcctccacgccaatcctctctccgtctttgaaagatccaaaaccatctcaaatgacccttcagaattcagctgcgtggtgaatgattacatacaagcggttaagcaactggcgtgtgagattcttgatctaacggctgagggcttgtgggtcccggataaacgtgcattcagcaggttcatcagagatgtccacagcgattctgttcttagacttaatcactaccctgcattcgaagagatcatggactgggacccatcacctaaaacaattggttttggcgagcactccgaccctcaaatcttgaccatcttgcgatccaacgacgttgggggcctccaaatttatttgcgtgatggcttgtgggtccctgttcctcctgaccccaccggattctatgtgatcgtgggggatgccttccaggttttaacgaatgggaggtttgaaagcgttagacacagagtgttggcgagctcggggaagccaagaatgtcaatgatgtactttggggcgccaccgcttaacgcatggatctctccgcctccacagctggtcttgccacaaaatccaagcctctacaaacccttcacttggagtgaattcaagaaagctgcctattctctgcgattgagagatacgcgtcttgacctcttcaagattcatgccacagaaaaatttgcttcttga

SEQ ID NO: 328 - protein, 331 aa, Populus trichocarpa
  misc_feature (1)..(331): Ceres Annot ID no. 1497828
  misc_feature (170)..(273): Pfam Name: 2OG-FeII_Oxy Pfam Description: 2OG-Fe(II) oxygenase superfamily
  misc_feature (1)..(331): Bit score of 412.1 for HMM based on sequences of Figure 5
  misc_feature (1)..(331): Functional Homolog Of SEQ ID NO. 287
MVVPSPTPARTRKTKAFGIPTVDLSLDRSNVSKLIVRACEEYGFFKVTNHGVSKEVVTRMEEEAAHFFSKPATEKHRAGPASPFGYGCKNIGYNGDMGELEYLLLHANPLSVFERSKTISNDPSEFSCVVNDYIQAVKQLACEILDLTAEGLWVPDKRAFSRFIRDVHSDSVLRLNHYPAFEEIMDWDPSPKTIGFGEHSDPQILTILRSNDVGGLQIYLRDGLWVPVPPDPTGFYVIVGDAFQVLTNGRFESVRHRVLASSGKPRMSMMYFGAPPLNAWISPPPQLVLPQNPSLYKPFTWSEFKKAAYSLRLRDTRLDLFKIHATEKFAS

SEQ ID NO: 329 - protein, 332 aa, Nerium oleander
  misc_feature (1)..(332): Public GI ID no. 51011366
  misc_feature (177)..(279): Pfam Name: 2OG-FeII_Oxy Pfam Description: 2OG-Fe(II) oxygenase superfamily
  misc_feature (1)..(332): Bit score of 613.8 for HMM based on sequences of Figure 5
  misc_feature (1)..(332): Functional Homolog Of SEQ ID NO. 287
MVVLSKPAMEQFCLVKNCKAPTLFPGVPLIDLSKPDSKHLLVKACQEFGFFKVINHGVPTEFITKLESEAVKFFSLPLSDKEKAGPPDPFGYGNKKIGPNGDIGWVEYIILSTNSEFNYQRFESIFGMTPEKFRDAVNDYVSSVKKMACEILELMAEGLNIQPKNVFSKLLMDEQSDSVFRLNHYPPYPDLQELHGRNLIGFGEHTDPQIISVLRSNNTSGLQIQLKDGSWISIPPDQSSFFINVGDSTQVLTNGRFKSVKHRVLANSMKSRLSMIYFGGPPLSEKIAPLPSLMEGEDSLYKEFTWFEYKKSAYKSRLADNRLVLFEKIAAS

SEQ ID NO: 330 - protein, 338 aa, Lactuca sativa
  misc_feature (1)..(338): Public GI ID no. 9971229
  misc_feature (171)..(282): Pfam Name: 2OG-FeII_Oxy Pfam Description: 2OG-Fe(II) oxygenase superfamily
  misc_feature (1)..(338): Bit score of 473.1 for HMM based on sequences of Figure 5
  misc_feature (1)..(338): Functional Homolog Of SEQ ID NO. 287
MVMISQVEKKPVVDIFPTKSNKTNFTGIPVIDLSSPEDAKNLIVNACQDYGFFKVINHGVSPLLVSELENEAIEFFNMRQYEKDQYCPPNPFGYGRNKIGTNGDVGWIEYLLLTSTNFPTNSKIFSSLTNEYVKEVRKLGCTILELMAEGLKIEPKNVLSRMLSDENADTVFRLNHYPPCLDPNSNHDSDLNNKSMSHGRTSIGFGEHTDPQLISIARSNATSGFQIYLEDGTWVGVPPDETSYFINVDDLLEVMTNGRFRSVRHRVVADSFKSRVSMIYFGGPPLMEKISPLGSLMEPGEESLYNEFTWFEYKSCTYKTRLTDNRLSLFHKHSHPVH

SEQ ID NO: 331 - DNA, 1394 bp, Triticum aestivum
  misc_feature (1)..(1394): Ceres Clone ID no. 615793
  misc_feature (1)..(1394): Encodes the peptide sequence at SEQ ID NO. 332
aagaacaagctcgacacacacacacacgcacacacgggaacagctagctagcttgctcttcgatcatcccgagctgcctgcgtgcgcacgtagctagctattcacagctcccgcgtagctagctagcttagctttggagccagccagccatgccggccttcgccgagagcacggccgagccgcctctggcggacagctactacgccctgctccgcggtggcaacaaagccgacgagtgcgcctcggcgccgccgcctggctgccaggccccgcccgtgtcggaatgcgagctcccgatgatcgacgttgggtgcctgacggcgtgcggcgggggcacggaggagagggcggcatgcgcggcggcgatagcgtccgcggccgctgaatggggcttcttccaggtggtcaaccacggcgtcaagcaggagctcctggaggcgatgcggcgggagcaggtgcgcctcttccgcctgccgttcgaggccaaggccacggccggccttctcaacgactcctaccgctggggctccccgaccgccacgtcgccaaggcagctgtcttggtccgaggccttccatgtcccgctcgccggcatctccggtagcccttgcagctacggcgagctcaccagcatcagggatgtgacgcaggaggtggcgaacgcgatgtcaaagctggccaacacgctggcgtgcgtcctggccgagagcctgggacataccgccggccaacgcttcccggaagggtgctacgagaggacgtgcttcctccggctgaacaggtacccgccgtgcccgttctcgccggacgccttcggcctggtgccgcacacggacagcgacttcctcaccgtgctctgccaggaccaagtcggcggcctgcagctgatgaagggctcccggtgggtggccgtcaagcccattcccggcgctctcatcgtcaacattggagacctcttccaggcatggagcaacaacagatacaagagcgtggagcacaaagtggtgaccaacgcgacgacggagaggtactccgtggcatacttcctttgcccgtcgtacgactcgcccatcggcgcatgcgaagagccttcaccttacaggaccttcaccttcggggagtatcggagaagggtgcaggaagacgtcaagaagacggggaagaagattggcctccccaattttctgctgtagattgctcctgcatggctataaaaatacatcttgcatgcagactaggcttgtttatccatgtcaatatgtacatgtttcctctgtatacgccgcccgtgtaatagtaagagcacgttattttattttatggttctctttctgaaactaagagtgcatgtgtcattgtaatttgttactcccctgtcttaaaatgatagtctc

SEQ ID NO: 332 - protein, 347 aa, Triticum aestivum
  misc_feature (1)..(347): Ceres Clone ID no. 615793
  misc_feature (207)..(302): Pfam Name: 2OG-FeII_Oxy Pfam Description: 2OG-Fe(II) oxygenase superfamily
  misc_feature (1)..(347): Bit score of 118.6 for HMM based on sequences of Figure 5
  misc_feature (1)..(347): Functional Homolog Of SEQ ID NO. 287
MPAFAESTAEPPLADSYYALLRGGNKADECASAPPPGCQAPPVSECELPMIDVGCLTACGGGTEERAACAAAIASAAAEWGFFQVVNHGVKQELLEAMRREQVRLFRLPFEAKATAGLLNDSYRWGSPTATSPRQLSWSEAFHVPLAGISGSPCSYGELTSIRDVTQEVANAMSKLANTLACVLAESLGHTAGQRFPEGCYERTCFLRLNRYPPCPFSPDAFGLVPHTDSDFLTVLCQDQVGGLQLMKGSRWVAVKPIPGALIVNIGDLFQAWSNNRYKSVEHKVVTNATTERYSVAYFLCPSYDSPIGACEEPSPYRTFTFGEYRRRVQEDVKKTGKKIGLPNFLL

SEQ ID NO: 333 - protein, 326 aa, marine gamma
  misc_feature (1)..(326): Public GI ID no. 119477815
  misc_feature (1)..(326): marine gamma proteobacterium HTCC2143
  misc_feature (179)..(275): Pfam Name: 2OG-FeII_Oxy Pfam Description: 2OG-Fe(II) oxygenase superfamily
  misc_feature (1)..(326): Bit score of 47.9 for HMM based on sequences of Figure 5
  misc_feature (1)..(326): Functional Homolog Of SEQ ID NO. 287
MTTIPLINIAALRSENTAERWAVVQSIATAFRDIGFMAVQGHNIPEQVISAMREQTRLLFKRPMDEKLALTVHPTNYRGYIPLGFFTPNGGGGAANKHADQYEAYKLHYEIAADDPICGQCDLYGPNRWPENSFALKAAVANYWRHCDRVTDELLLAIAAFFESDPAYFKQALTKPLTNMTLLHYPPCNRGVDHFGIHPHKDTDLLTVLAADLIGGLYLRPRQAKQWMEAKVPSDALIVNVGDMLEIWSGGYFMSTPHKVVNESDQHRYSFPYFSVPRFDITISPPGDSMNFDRAAMRAGEVSKKIWRSNWPNVDSVEEEIDPYTY

SEQ ID NO: 334 - protein, 349 aa, Solanum lycopersicum
  misc_feature (1)..(349): Public GI ID no. 126843206
  misc_feature (164)..(280): Pfam Name: 2OG-FeII_Oxy Pfam Description: 2OG-Fe(II) oxygenase superfamily
  misc_feature (1)..(349): Bit score of 368.4 for HMM based on sequences of Figure 5
  misc_feature (1)..(349): Functional Homolog Of SEQ ID NO. 287
MVSEKIQENIKLPIIDLSLEKSQILKLIVKASEEFGFFKVINHGVDTNVIKKMEDESYNFFSKSFSQKQCAGPANPYGYGCKNIGFNGDNGEVEYLLLHANPNMSISQISKNISSDPLMFSCAVNGYVKSVRELACKILELMAQGLRVQQTSVYSNLLMDLHSDSLLRINHYPPFNWTPHLLHHDCDTSPNSCNSTVSKIGFGEHTDPQILTILRSNDAPGLQISTQQGLWVPVSPHPNTAFSIFVGDTLQALTNGRFKSVRHRAMVNSCKPRMSMVYFGAPSPHARICCPLELVTTTPHKPYHLYRPFTWGEYKKATYSMRLGDTRLDQFFRLQSENDETITINNQTS

SEQ ID NO: 335 - protein, 366 aa, Zea mays
  misc_feature (1)..(366): Public GI ID no. 226505220
  misc_feature (178)..(307): Pfam Name: 2OG-FeII_Oxy Pfam Description: 2OG-Fe(II) oxygenase superfamily
  misc_feature (1)..(366): Bit score of 335.4 for HMM based on sequences of Figure 5
  misc_feature (1)..(366): Functional Homolog Of SEQ ID NO. 287
MVVPSTTPVVRQETPPPSHDGIGIPTVDLSAPGGRGALSRQVARACAQHGFFRAVNHGVAPGPAARLDAAARTFFALAPHNKQRAGPPSPLGYGCRSIGFNGDAGELEYLLLHANPAAVAHRARSIDTDDPSRFSNVVNEYVGAMRQLACEILDLLGEGLGLKDPRSFSRLIADTDSDSLLRINHYPPPCAIHKLDHDSQCRMKNSFRIVAGNGANQSAGARIGFGEHSDPQILSLLRSNDVDGLQVLLNSDGREVWVQVPADPSAFFVNVGDLLQAFTNGKVISVRHRVIASSSRARLSTIYFAAPPLHARILALPETVTANSPRQYRPFTWAEYKKTMYSLRLSHSRLNLFHIGHDDHGKGEQE

SEQ ID NO: 336 - protein, 332 aa, Phaseolus coccineus
  misc_feature (1)..(332): Public GI ID no. 49035968
  misc_feature (177)..(278): Pfam Name: 2OG-FeII_Oxy Pfam Description: 2OG-Fe(II) oxygenase superfamily
  misc_feature (1)..(332): Bit score of 583.8 for HMM based on sequences of Figure 5
  misc_feature (1)..(332): Functional Homolog Of SEQ ID NO. 287
MVVLSQPALNQFFLLKPFKSTPLFTGIPVVDLTHPDAKNLIVNACRDFGFFKLVNHGVPLELMANLENEALRFFKKSQSEKDRAGPPDPFGYGSKRIGPNGDVGWVEYLLLNTNPDVISPKSLCIFRENPHHFRAVVENYITAVKNMCYAVLELMAEGLGIRQRNTLSRLLKDEKSDSCFRLNHYPPCPEVQALNRNLVGFGEHTDPQIISVLRSNSTSGLQICLTDGTWVSVPPDQTSFFINVGDALQVMTNGRFKSVKHRVLADTTKSRLSMIYFGGPALSENIAPLPSVMLKGEECLYKEFTWCEYKKAAYTSRLADNRLAPFQKSAAD

SEQ ID NO: 337 - protein, 346 aa, Sorghum bicolor
  misc_feature (1)..(346): Public GI ID no. 242057261
  misc_feature (173)..(283): Pfam Name: 2OG-FeII_Oxy Pfam Description: 2OG-Fe(II) oxygenase superfamily
  misc_feature (1)..(346): Bit score of 361.5 for HMM based on sequences of Figure 5
  misc_feature (1)..(346): Functional Homolog Of SEQ ID NO. 287
MVVPSAAGREMAPESLPLGIIPTVDMSAPCGELARRLVRACAERGFFKAVNHGVPPRVSARMDAAASAFFARPGQAKQAAGPPDPLGYGSRNIGANGDVGELEYLILHADPGAVARKAKVIDKDDPSRFSVAVNEYVGAVRHLACRVLDLLGEGLGLRDPTSLSRLISAVDSDSLLRINHYPTSRSSAADISTKGIGFGEHTDPQILSLLRANDVDGLQVLLPDGHGGGDEQWVQVPADPSAFFINVGDLLQALTNGRLVSIRHRVMASTTRPRLSTIYFAAPPLDARVAALPETVTAGAPRRYRTFTWAEYKKAMYALRLSHNRLDLFHATSGSSRDVIDDDHEQ

SEQ ID NO: 338 - protein, 335 aa, Arabidopsis thaliana
  misc_feature (1)..(335): Public GI ID no. 15226777
  misc_feature (1)..(335): Public GI ID no. 2
  misc_feature (177)..(278): Pfam Name: 2OG-FeII_Oxy Pfam Description: 2OG-Fe(II) oxygenase superfamily
  misc_feature (1)..(335): Bit score of 475.0 for HMM based on sequences of Figure 5
  misc_feature (1)..(335): Functional Homolog Of SEQ ID NO. 287
MVIVLQPASFDSNLYVNPKCKPRPVLIPVIDLTDSDAKTQIVKACEEFGFFKVINHGVRPDLLTQLEQEAINFFALHHSLKDKAGPPDPFGYGTKRIGPNGDLGWLEYILLNANLCLESHKTTAIFRHTPAIFREAVEEYIKEMKRMSSKFLEMVEEELKIEPKEKLSRLVKVKESDSCLRMNHYPEKEETPVKEEIGFGEHTDPQLISLLRSNDTEGLQICVKDGTWVDVTPDHSSFFVLVGDTLQVMTNGRFKSVKHRVVTNTKRSRISMIYFAGPPLSEKIAPLSCLVPKQDDCLYNEFTWSQYKLSAYKTKLGDYRLGLFEKRPPFSLSNV

SEQ ID NO: 339 - protein, 323 aa, Vitis vinifera
  misc_feature (1)..(323): Public GI ID no. 147838315
  misc_feature (168)..(270): Pfam Name: 2OG-FeII_Oxy Pfam Description: 2OG-Fe(II) oxygenase superfamily
  misc_feature (1)..(323): Bit score of 556.9 for HMM based on sequences of Figure 5
  misc_feature (1)..(323): Functional Homolog Of SEQ ID NO. 287
MGVFSKPAIEQLPLIRNCMPFSGIPLIDLSQPDSKALLIEACQEFGFFKVINHGVPMDLISKLEAEAVNFFSLPLSEKEKAGPPNPSGYGNKRIGSSGDIGRVEYLLLNPQSFPSVFGQNPDMFRSAVSDYLSAVRKMACEILELLADGLMIQPRNVFSKLLMDEQSDSVFRLNHYPPYPERQALSGKCMIGFGEHTDPQIISVLRSNNTSGLQISLRNGNWISVPPDENSFFINVGDSLQVMTNGRFQSVKHRVLTNSCKSRVSMIYFGGPPLSEKIAPLPSLMEGEESHYKEFTWFEYKRSAYNTRLADNRLVFFQKVAAT

SEQ ID NO: 340 - protein, 339 aa, Vigna angularis
  misc_feature (1)..(339): Public GI ID no. 108755538
  misc_feature (180)..(285): Pfam Name: 2OG-FeII_Oxy Pfam Description: 2OG-Fe(II) oxygenase superfamily
  misc_feature (1)..(339): Bit score of 503.1 for HMM based on sequences of Figure 5
  misc_feature (1)..(339): Functional Homolog Of SEQ ID NO. 287
MVVLSNQSALNELFLAKTCNPSTMFTEVPEVDLSHPDAKTIMVKACQEIGLFKLVNHGLPLEMITRLENEALKFFTQSQSVKDKAGPPDPFGVWAARELARTGDMGWVEYLLLSTNPDIVSPKTVQLFNQNPQSFRLCVEEYIGAMKKICCEVLEEMGDGLGLGRRKNVFSRMIREERSDSCFRVNRYPACGELKDESALSGRNLIGFGEHTDPQILSVLRSNNTSGLQICLPDGTWASIPPDHSSFFVNVGDLLQVMTNGRFKSVKHRVLADSRLSRLSMIYFGGPSLEEKIAPLPSLVSKEEESLYRELTWREYKNAAYKTRLSDDRITLFYKSSNT

SEQ ID NO: 341 - protein, 322 aa, Populus trichocarpa
  misc_feature (1)..(322): Public GI ID no. 224064641
  misc_feature (170)..(273): Pfam Name: 2OG-FeII_Oxy Pfam Description: 2OG-Fe(II) oxygenase superfamily
  misc_feature (1)..(322): Bit score of 410.3 for HMM based on sequences of Figure 5
  misc_feature (1)..(322): Functional Homolog Of SEQ ID NO. 287
MVVPSPTPARTRKTKAFGIPTVDLSLDRSNVSKLIVRACEEYGFFKVTNHGVSKEVVTRMEEEAAHFFSKPATEKHRAGPASPFGYGCKNIGYNGDMGELEYLLLHANPLSVFERSKTISNDPSEFSCVVNDYIQAVKQLACEILDLTAEGLWVPDKRAFSRFIRDVHSDSVLRLNHYPAFEEIMDWDPSPKTIGFGEHSDPQILTILRSNDVGGLQIYLRDGLWVPVPPDPTGFYVIVGDAFQVLTNGRFESVRHRVLASSGKPRMSMMYFGAPPLNAWISPPPQLVLPQNPSLYKPFTWSEFKKAAYSLRLRDTRLDLFK

SEQ ID NO: 342 - protein, 340 aa, Solanum tuberosum
  misc_feature (1)..(340): Public GI ID no. 152003423
  misc_feature (182)..(285): Pfam Name: 2OG-FeII_Oxy Pfam Description: 2OG-Fe(II) oxygenase superfamily
  misc_feature (1)..(340): Bit score of 535.1 for HMM based on sequences of Figure 5
  misc_feature (1)..(340): Functional Homolog Of SEQ ID NO. 287
MVVLSQPLVENFSHIKTCKHNNTTSDHVYTGIIPVIDLLDPEANNLIIKACQEFGFFKVVNHGVPIETITKLENESINFFNLSQIEKDKVGPANPFGYGNKRIGSKGDVGWVEYLLFTTNPELNHNKSITIPGNSLLFWGLVKEYISAVRNMGCMVLEMIAEGLNIEPKNILSRMLSDEKSDSCFRLNHYPPCPELLQALSGRNLIGFGEHTDPQVISVGRSNNTSGLQISLKDGTWISVPPDPYSFFINVGDSLQAMSNGRFMSVRHRVIADCLKARVSMVYFGGPPLSEKIAPLSCLMEEPNEQILYNEFTWSEYKISAYKTRLGDNRLSLFEKNAQS

SEQ ID NO: 343 - DNA, 1005 bp, Populus trichocarpa
  misc_feature (1)..(1005): Ceres Annot ID no. 1448918
  misc_feature (1)..(1005): Encodes the peptide sequence at SEQ ID NO. 344
atggtagtactttcccaactagctctagaacctttctcagttatcaaaacatgcaagcctataggcttgttttccgagatacccgttatagacttgacagaccctcatgccaagactctcataatcaaggcctgtgaagagtttggattcttcaagctggtaaatcatggagttccaatggaagtcatgaccaaattggaagctcttgctaccaacttctttaacctcccccagcctgagaaagacaaggctggacctcctaacccttttggctacggaaacaagaaaattggccctaatggtgatgttggttgggttgaatatctcctccttaacaccaaccctcaaatctcctcccaaaaaacgtccatttttcaggaaaacccacagattttccgctctgctgttgaagattacatactggcagtgaagagaatggcttttgaagtattggaattgatggctgatgggctggagattgagtcaaggaatgtgttcagtaggctgttgagggatgataagagtgattcatgtttcaggctaaaccactacccaccatgctcagagctgcaagcattgagtggtggaaatttgattgggtttggcgagcacacagacccacagataatatctgttctaagatctaacaacacaagtggcctgcaaatttgtctgaaagagggaacttgggtttcagtcccccctgatcagacctcttttttcatcaatgttggtgatgccttgcaggtgatgacaaatggaaggtttaggagtgtcaagcacagggttttggctgatcccctgaaaccaaggatttccatgattttcttcggtggtccacctttaagtgaaaagatagcacctttaccctccttgatggcagaaagaggaggaagcttatacaaggagttcacatggtttgaatacaaaagtgatggtaatcatgctgatgcaaagccacaatgggccaccttgactcatgagaagcatggctacaattactag

SEQ ID NO: 344 - protein, 334 aa, Populus trichocarpa
  misc_feature (1)..(334): Ceres Annot ID no. 1448918
  misc_feature (176)..(278): Pfam Name: 2OG-FeII_Oxy Pfam Description: 2OG-Fe(II) oxygenase superfamily
  misc_feature (1)..(334): Bit score of 564.6 for HMM based on sequences of Figure 5
  misc_feature (1)..(334): Functional Homolog Of SEQ ID NO. 287
MVVLSQLALEPFSVIKTCKPIGLFSEIPVIDLTDPHAKTLIIKACEEFGFFKLVNHGVPMEVMTKLEALATNFFNLPQPEKDKAGPPNPFGYGNKKIGPNGDVGWVEYLLLNTNPQISSQKTSIFQENPQIFRSAVEDYILAVKRMAFEVLELMADGLEIESRNVFSRLLRDDKSDSCFRLNHYPPCSELQALSGGNLIGFGEHTDPQIISVLRSNNTSGLQICLKEGTWVSVPPDQTSFFINVGDALQVMTNGRFRSVKHRVLADPLKPRISMIFFGGPPLSEKIAPLPSLMAERGGSLYKEFTWFEYKSDGNHADAKPQWATLTHEKHGYNY

SEQ ID NO: 345 - DNA, 1275 bp, Triticum aestivum
  misc_feature (1)..(1275): Ceres Clone ID no. 909614
  misc_feature (1)..(1275): Encodes the peptide sequence at SEQ ID NO. 346
agcacaaccgcaaacgttcgcagctcatcccctgtccctctgctctcttctgctcctcctctgcttgcttcactacatatcgggtgctctgcgagatcgtctgccggccatggtggcgatcacggtgcccatctcggtggacacgatcccgctggtgaaatgcgcgaatgcggcggcggcggcggtgccgagcgtcgacctgtcggcgccgggcgctgcggcggccgtcgcggacgcgtgccgcggcgtgggcttcttcagggcgaccaaccacggcgtgccggcggccctcgcggaggcgctggaggaacgcgccgcggccttcttcgcgctgccgcacaaggacaagctggaggcgtcggcgcggcccttgggctacggcagcaagagcatcggctgcaacggcgacgtgggctggctcgagtacatcctgctctccgtcgggtctggctcggtcgccgccgcctccctgccgccgctgctccgggcggcgctggaggagtacgcggacgcggtgcgggaggtgggagcgcgggtgctggagctcatggcggatgggctcggcgtcgcggaggagcaccgcggcgtgctgcggcggatggtggcgccggacgaagccgacgagttggtgcgcgtgaaccactacccgccgtgcccttgccccctggcggcggggcagcgcggcgtgacggggtttggggagcacacggacccgcagatcatctccgtgctccggtccaaccgcaccgggggcctccagatcatgctcccggacggccgctgggtccccgttgcccccgaccccgattccctcttcgtcaatgtcggggactccctccaggtgctgacgaacgggcggttccagagcgtgaagcaccgggtggtggcgccggcggaggggcagcagtcgcggctgtcggtgatctacttcggcgggccggcgccggcgcagcggatcgcgccgctgccggagctgatgcgtgagggtgagcggagcctgtatagggagttcacctgggccgagtacaagaaggccgcctacaagtcccgcctcggcgaccaccgcctcggccccttcgagctcccagccgccaaagaacccaacagctccgaccagcacagcagcagcaacgccgtccagccgccggcgcgggcgccccctcacgtggcaccagtgtactagactaccagtgtagttagcttagtactagtgacttttttgttcttgtttaattaatgtaatcacccggaaaattgaatgtaatttatccaccc

SEQ ID NO: 346 - protein, 357 aa, Triticum aestivum
  misc_feature (1)..(357): Ceres Clone ID no. 909614
  misc_feature (171)..(275): Pfam Name: 2OG-FeII_Oxy Pfam Description: 2OG-Fe(II) oxygenase superfamily
  misc_feature (1)..(357): Bit score of 419.1 for HMM based on sequences of Figure 5
  misc_feature (1)..(357): Functional Homolog Of SEQ ID NO. 287
MVAITVPISVDTIPLVKCANAAAAAVPSVDLSAPGAAAAVADACRGVGFFRATNHGVPAALAEALEERAAAFFALPHKDKLEASARPLGYGSKSIGCNGDVGWLEYILLSVGSGSVAAASLPPLLRAALEEYADAVREVGARVLELMADGLGVAEEHRGVLRRMVAPDEADELVRVNHYPPCPCPLAAGQRGVTGFGEHTDPQIISVLRSNRTGGLQIMLPDGRWVPVAPDPDSLFVNVGDSLQVLTNGRFQSVKHRVVAPAEGQQSRLSVIYFGGPAPAQRIAPLPELMREGERSLYREFTWAEYKKAAYKSRLGDHRLGPFELPAAKEPNSSDQHSSSNAVQPPARAPPHVAPVY

SEQ ID NO: 347 - protein, 341 aa, Arabidopsis lyrata
  misc_feature (1)..(341): Public GI ID no. 297845928
  misc_feature (1)..(341): Arabidopsis lyrata subsp. lyrata
  misc_feature (181)..(281): Pfam Name: 2OG-FeII_Oxy Pfam Description: 2OG-Fe(II) oxygenase superfamily
  misc_feature (1)..(341): Bit score of 522.7 for HMM based on sequences of Figure 5
  misc_feature (1)..(341): Functional Homolog Of SEQ ID NO. 287
MVVLPQPVTLENHISLIPTYKPVPVLTSHSIPVVNLTDPEAKTRIVKACEEFGFFKVVNHGVRPELMTRLEQEAIGFFALPQSLKNRAGPPEPYGYGNKRIGPNGDVGWIEYILLNANPQLSSPKTSAVFRQTPQIFRESVEEYMKEIKEVSYKVLEMVAEELGIEPRDTLSKMLRDEKSDSCLRLNHYPAAEEEAEKMVKVGFGEHTDPQIISVLRSNNTAGLQICVKDGSWVAVPPDHSSFFINVGDALQVMTNGRFKSVKHRVLADTRRSRISMIYFGGPPLSEKIAPLPCLVPEQDDWLYKEFTWSQYKSSAYKSKLGDYRLGLFEKQPLLTHKTIV

SEQ ID NO: 348 - protein, 323 aa, Vitis vinifera
  misc_feature (1)..(323): Public GI ID no. 225470621
  misc_feature (168)..(270): Pfam Name: 2OG-FeII_Oxy Pfam Description: 2OG-Fe(II) oxygenase superfamily
  misc_feature (1)..(323): Bit score of 556.6 for HMM based on sequences of Figure 5
  misc_feature (1)..(323): Functional Homolog Of SEQ ID NO. 287
MGVFSKPAIEQLPLIRNCMPFSGIPLIDLSQPDSKALLIEACQEFGFFKVINHGVPMDLISKLEAEAINFFSLPLSEKEKAGPPNPSGYGNKRIGSSGDIGRVEYLLLNPQSFPSVFGQNPDMFRSAVSDYLSAVRKMACEILELLADGLMIQPRNVFSKLLMDEQSDSVFRLNHYPPYPERQALSGKCMIGFGEHTDPQIISVLRSNNTSGLQISLRNGNWISVPPDENSFFINVGDSLQVMTNGRFQSVKHRVLTNSCKSRVSMIYFGGPPLSEKIAPLPSLMEGEESHYKEFTWFEYKRSAYNTRLADNRLVFFQKVAAT

SEQ ID NO: 349 - protein, 382 aa, Oryza sativa
  misc_feature (1)..(382): Public GI ID no. 115462223
  misc_feature (1)..(382): Oryza sativa Japonica Group
  misc_feature (193)..(321): Pfam Name: 2OG-FeII_Oxy Pfam Description: 2OG-Fe(II) oxygenase superfamily
  misc_feature (1)..(382): Bit score of 315.9 for HMM based on sequences of Figure 5
  misc_feature (1)..(382): Functional Homolog Of SEQ ID NO. 287
MVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 350 - protein, 326 aa, Triticum aestivum
  misc_feature (1)..(326): Public GI ID no. 327179117
  misc_feature (175)..(276): Pfam Name: 2OG-FeII_Oxy Pfam Description: 2OG-Fe(II) oxygenase superfamily
  misc_feature (1)..(326): Bit score of 548.1 for HMM based on sequences of Figure 5
  misc_feature (1)..(326): Functional Homolog Of SEQ ID NO. 287
MVVLASTPAVDHIPLLRSPDPGDYFSGMPVVDLSSPGAPRVIADACERFGFFKLVNHGVPADTMDRLESEAVRFFSLPQADKDRSGPAYPFGYGSKRIGLNGDMGWLEYLLLAVESASLSGACTVPSCALFRAALNEYIAAVRKVAVRVMEAMAEGLGIAPVDALSAMVTAGGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNRLAQFHR

SEQ ID NO: 351 - protein, 341 aa, Arabidopsis thaliana
  misc_feature (1)..(341): Public GI ID no. 15220645
  misc_feature (1)..(341): Public GI ID no. 2
  misc_feature (181)..(281): Pfam Name: 2OG-FeII_Oxy Pfam Description: 2OG-Fe(II) oxygenase superfamily
  misc_feature (1)..(341): Bit score of 522.0 for HMM based on sequences of Figure 5
  misc_feature (1)..(341): Functional Homolog Of SEQ ID NO. 287
MVVLPQPVTLDNHISLIPTYKPVPVLTSHSIPVVNLADPEAKTRIVKACEEFGFFKVVNHGVRPELMTRLEQEAIGFFGLPQSLKNRAGPPEPYGYGNKRIGPNGDVGWIEYLLLNANPQLSSPKTSAVFRQTPQIFRESVEEYMKEIKEVSYKVLEMVAEELGIEPRDTLSKMLRDEKSDSCLRLNHYPAAEEEAEKMVKVGFGEHTDPQIISVLRSNNTAGLQICVKDGSWVAVPPDHSSFFINVGDALQVMTNGRFKSVKHRVLADTRRSRISMIYFGGPPLSQKIAPLPCLVPEQDDWLYKEFTWSQYKSSAYKSKLGDYRLGLFEKQPLLNHKTLV

SEQ ID NO: 352 - protein, 326 aa, Triticum aestivum
  misc_feature (1)..(326): Public GI ID no. 327179119
  misc_feature (175)..(274): Pfam Name: 2OG-FeII_Oxy Pfam Description: 2OG-Fe(II) oxygenase superfamily
  misc_feature (1)..(326): Bit score of 542.5 for HMM based on sequences of Figure 5
  misc_feature (1)..(326): Functional Homolog Of SEQ ID NO. 287
MVVLASTPAIDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVESASLSGACTVPSCALFRAALNEYIAAVRKVAVRVMEAMAEGLGIAPVDALSAMVTAGGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYVGGPAMTQRIAPLPQLLGAGEQSLYKDFAWGEYKKAAYNSRLGDNRLAHFHR

SEQ ID NO: 353 - protein, 327 aa, Pisum sativum
  misc_feature (1)..(327): Public GI ID no. 6446413
  misc_feature (174)..(276): Pfam Name: 2OG-FeII_Oxy Pfam Description: 2OG-Fe(II) oxygenase superfamily
  misc_feature (1)..(327): Bit score of 555.4 for HMM based on sequences of Figure 5
  misc_feature (1)..(327): Functional Homolog Of SEQ ID NO. 287
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQDHNFSLYGEDIHKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 354 - protein, 335 aa, Arabidopsis lyrata
  misc_feature (1)..(335): Public GI ID no. 297823239
  misc_feature (1)..(335): Arabidopsis lyrata subsp. lyrata
  misc_feature (177)..(278): Pfam Name: 2OG-FeII_Oxy Pfam Description: 2OG-Fe(II) oxygenase superfamily
  misc_feature (1)..(335): Bit score of 473.4 for HMM based on sequences of Figure 5
  misc_feature (1)..(335): Functional Homolog Of SEQ ID NO. 287
MVIVLQPATFDSNLYVNPKCKPSPVLIPVIDLTDSDAKTQIVKACEEFGFFKVINHEVRPDLLSQLEQEAIKFFASPHSLKDKASPPDPFGYGTKRIGPNGDVGWLEYILLNANLCLESHKTTAVFRHTPAIFREAVEEYMKEMKRMSSKVLEMVEEELKIEPKEKLSHLVKVKESDSCLRMNHYPEKEETPAKGEIGFGEHTDPQLISLLRSNDTKGFQICVKDGTWVDVSPDHSSFFVLVGDTLQVMTNGRFKSVKHRVVTNTKRSRISMIYFAGPPLSEKIAPLSCLVPKQDDCLYNEFTWSQYKLSAYKTKLGGYRLGLFERPPPFSLSSV

SEQ ID NO: 355 - protein, 329 aa, Spinacia oleracea
  misc_feature (1)..(329): Public GI ID no. 27261179
  misc_feature (168)..(274): Pfam Name: 2OG-FeII_Oxy Pfam Description: 2OG-Fe(II) oxygenase superfamily
  misc_feature (1)..(329): Bit score of 356.1 for HMM based on sequences of Figure 5
  misc_feature (1)..(329): Functional Homolog Of SEQ ID NO. 287
MVVASPNPLKRSKKTKAMGVPTIDLSLKYQQRSTLTDLIVEACEDFGIFKVVNHGISTEVISALENHGLDFFSKPTPEKHLVVGPTVPKPFGYGFRNIGNNGDVGDLEYLLLHANLSSTHPPLFGEAVDDYVGAVADLSCELLDLMAEGLWVSDKTIFSKLIRDVQSDSLLRLNHYPPLKNKDSFINGSGERIGFGEHSDPQILTILRSNDVGGLQICMPDGLWVPVQPDPNAFYVMVGDALQVLTNGRFGSVKHRAMANNSTTKARMSMNFFGAPPLNATISPIQEMVSPMNPNLYKPFTWGEYKRAMHSSRLSDCRLNLFKRRINDQ

SEQ ID NO: 356 - protein, 345 aa, Pisum sativum
  misc_feature (1)..(345): Public GI ID no. 49035760
  misc_feature (172)..(285): Pfam Name: 2OG-FeII_Oxy Pfam Description: 2OG-Fe(II) oxygenase superfamily
  misc_feature (1)..(345): Bit score of 405.1 for HMM based on sequences of Figure 5
  misc_feature (1)..(345): Functional Homolog Of SEQ ID NO. 287
MVVPSPTSMIRTKKTKAVGIPTIDLSLERSQLSELVVKACEEYGFFKVVNHSVPKEVISRLDEEGIEFFSKNSSEKRQAGTSTPFGYGCKNIGPNGDKGELEYLLLHSNPISISERSKTIAKDHPIKFSCIVNDYIKAVKDLTCEILELAAEGLWVPDKSSLSKIIKDEHSDSLLRINHYPPVKKLGNDNWDPSKIQNSNNNNIGFGEHSDPQILTILRSNNVGGLQISTHHGLWIPVPPDPSEFYVMVGDALQVLTNGRFVSVRHRVLTNTTKPRMSMMYFAAPPLNWLISPLSKMVTAHSPCLYRPFTWAQYKQAAYALRLGDTRLDQFKVQKQEDSNDSHSL

SEQ ID NO: 357 - protein, 329 aa, Arabidopsis lyrata
  misc_feature (1)..(329): Public GI ID no. 297843038
  misc_feature (1)..(329): Arabidopsis lyrata subsp. lyrata
  misc_feature (177)..(280): Pfam Name: 2OG-FeII_Oxy Pfam Description: 2OG-Fe(II) oxygenase superfamily
  misc_feature (1)..(329): Bit score of 363.9 for HMM based on sequences of Figure 5
  misc_feature (1)..(329): Functional Homolog Of SEQ ID NO. 287
MVLPSSTPLQITGKKTKSLPEYSFPVIDFSLNDRSKLSEKIVKACECNGFFKVINHGVKPEIISRFEHEGEEFFNKPESDKLRAGPASPFGYGCKNIGFNGDLGELEYLLLHANPTAVADQSETISHDDPFKFSSATNDYIRAVKDLACEIIDMTIENLWGQRSSEVSELIRDVRSDSILRLNHYPPAPYALRGVGQIGFGEHSDPQILTVLRSNDVDGLEICSRDGLWIPIQSDPTCFFVLVGDCLQALTNGRFTSVRHRVLANIAKKPRMSAMYFAAPPLEAKISPLPKMVSPENPRRYNSFTWGDYKKATYSLRLGVPRLEFFKTL

SEQ ID NO: 358 - protein, 306 aa, Physcomitrella patens
  misc_feature (1)..(306): Public GI ID no. 168063557
  misc_feature (1)..(306): Physcomitrella patens subsp. patens
  misc_feature (151)..(246): Pfam Name: 2OG-FeII_Oxy Pfam Description: 2OG-Fe(II) oxygenase superfamily
  misc_feature (1)..(306): Bit score of 175.7 for HMM based on sequences of Figure 5
  misc_feature (1)..(306): Functional Homolog Of SEQ ID NO. 287
MAQELPTVDLSDLHHGSEESREATAKLLVKTFSEWGFVQVINHGVPTEVIEKMQNQARNFFDLPLEQKEKGVASSTSKHEGFGYGFNSFNRGFLTLYAYRVFISCSTSIEDYNGRLDKLAMQILELTAQGLGLPSDTFIKPFNGTAGDCIARMNYYPPCPLSSLTLGLGAHTDPNLLTILSQCKVGGLQVCKNGTWISVKPKPDTLIINIGDTFEAWTNGRFCSVEHRAVVNESEARMSLVYFASPPSKSVIQIPEQLITAKHPLRFRPSFTWEEYKSHLFKRHVGGNGVKTSKEWLRLPAPTSHT

SEQ ID NO: 359 - DNA, 862 bp, Triticum aestivum
  misc_feature (1)..(862): Ceres Clone ID no. 829454
  misc_feature (1)..(862): Encodes the peptide sequence at SEQ ID NO. 360
aatgtcaacctaactgccttctccattcctcctctgtttcttggatacaaaccgactgacaccctctagttcattagcataggctctccgtgcttcctctgctttgtaaccatggtggttcttgccaagggcgagctggagcagatcgcgctcccggccgtgcacaagacggcgccgccactggccgacgtgccggaggtcgacctttccgtggcgggtagcggctctgatggacgggcggccgccgcacgcgcggtggcgctggcgtgcgaggagcacgggttcttcaaggtgacgggccacggcgtgccggcagagctcctgacgcgcgtcgagaacgccgctgccgccttcttcgcgctctcgcagcgggacaaggaggcggcgatgtcggccgcgacgcysggcagtccgttcggctacgcaagcaagcggataggcaacaacggcgacctcgggtgggtcgagtatctcctgctcggtgtctccgccgcgaccagcgggccactgtccgtgcccgaaggggtggtgccgtcagcgtcgctctgctctttccgcgaccttctgaacgagtacacggtggccgtgaggaggatgacctgccaggcgctggagctgatggcggagggcctgggcatggacgacagggacgccttcaccaggctggtcctgcacaaggaaagcgactcgatgctgcgggtgaaccactacccgccgcgccccgagctgaagctcctgcagcagcagcagcaacacggcggcggcggcagggtcaccgggttcggcgagcacaccgaccctcagatcatctccgtgctccgctccaacgccacctctggcctcgagatcgcgctgcgcgacg

SEQ ID NO: 360 - protein, 250 aa, Triticum aestivum
  misc_feature (1)..(250): Ceres Clone ID no. 829454
  misc_feature (192)..(247): Pfam Name: 2OG-FeII_Oxy Pfam Description: 2OG-Fe(II) oxygenase superfamily
  misc_feature (1)..(250): Bit score of 241.9 for HMM based on sequences of Figure 5
  misc_feature (1)..(250): Functional Homolog Of SEQ ID NO. 287
  misc_feature (98)..(98): Xaa is any aa, unknown, or other
MVVLAKGELEQIALPAVHKTAPPLADVPEVDLSVAGSGSDGRAAAARAVALACEEHGFFKVTGHGVPAELLTRVENAAAAFFALSQRDKEAAMSAATXGSPFGYASKRIGNNGDLGWVEYLLLGVSAATSGPLSVPEGVVPSASLCSFRDLLNEYTVAVRRMTCQALELMAEGLGMDDRDAFTRLVLHKESDSMLRVNHYPPRPELKLLQQQQQHGGGGRVTGFGEHTDPQIISVLRSNATSGLEIALRD

SEQ ID NO: 361 - protein, 336 aa, Arabidopsis thaliana
  misc_feature (1)..(336): Public GI ID no. 2
  misc_feature (196)..(291): Pfam Name: 2OG-FeII_Oxy Pfam Description: 2OG-Fe(II) oxygenase superfamily
  misc_feature (1)..(336): Bit score of 123.5 for HMM based on sequences of Figure 5
  misc_feature (1)..(336): Functional Homolog Of SEQ ID NO. 287
MASQPPFKTNFCSIFGSSFPNSTSESNTNTSTIQTSGIKLPVIDLSHLTSGEEVKRKRCVKQMVAAAKEWGFFQIVNHGIPKDVFEMMLLEEKKLFDQPFSVKVRERFSDLSKNSYRWGNPSATSPAQYSVSEAFHIILSEVSRISDDRNNLRTIVETYVQEIARVAQMICEILGKQVNVSSEYFENIFELENSFLRLNKYHPSVFGSEVFGLVPHTDTSFLTILSQDQIGGLELENNGQWISVKPCLEALTVNIGDMFQALSNGVYQSVRHRVISPANIERMSIAFFVCPYLETEIDCFGYPKKYRRFSFREYKEQSEHDVKETGDKVGLSRFLI

SEQ ID NO: 362 - protein, 354 aa, Oryza sativa
  misc_feature (1)..(354): Public GI ID no. 125552976
  misc_feature (1)..(354): Oryza sativa Indica Group
  misc_feature (177)..(287): Pfam Name: 2OG-FeII_Oxy Pfam Description: 2OG-Fe(II) oxygenase superfamily
  misc_feature (1)..(354): Bit score of 459.5 for HMM based on sequences of Figure 5
  misc_feature (1)..(354): Functional Homolog Of SEQ ID NO. 287
MVVLAKPAALEQISLVRSPSVEDNFGAGLPVVDLAADGAAGEVVRACERFGFFKVVSHGVGEGVVGRLEAEAVRFFASPQAAKDAHGPASPFGYGSKRIGRNGDMGWLEYLLLAIDGASLSRSSPAPSSSLRDAANKYVGAMRGMARTVLEMVAEGLGVAPRGALADMVVGDGAASDQILRLNHYPPCPPLLQNLMPNCSPTGFGEHTDPQLISILHSNSTSGLQVALHHDADAGDHQWVTVPPDPASFLVIVGDSLQVMTNGRMRSVRHRVVANKLKSRVSMIYFGGPPLEQRIAPLRQLLVAGVGDGEEEEQSRYEEFTWGEYKKAAYLSRLSDNRLAPFHRQPPPVANPLA

SEQ ID NO: 363 - protein, 268 aa, Arabidopsis thaliana
  misc_feature (1)..(268): Public GI ID no. 79318890
  misc_feature (181)..(253): Pfam Name: 2OG-FeII_Oxy Pfam Description: 2OG-Fe(II) oxygenase superfamily
  misc_feature (1)..(268): Bit score of 369.2 for HMM based on sequences of Figure 5
  misc_feature (1)..(268): Functional Homolog Of SEQ ID NO. 287
MVVLPQPVTLDNHISLIPTYKPVPVLTSHSIPVVNLADPEAKTRIVKACEEFGFFKVVNHGVRPELMTRLEQEAIGFFGLPQSLKNRAGPPEPYGYGNKRIGPNGDVGWIEYLLLNANPQLSSPKTSAVFRQTPQIFRESVEEYMKEIKEVSYKVLEMVAEELGIEPRDTLSKMLRDEKSDSCLRLNHYPAAEEEAEKMVKVGFGEHTDPQIISVLRSNNTAGLQICVKDGSWVAVPPDHSSFFINVGDALQVPFPLFFLFFYIYLKI

SEQ ID NO: 364 - protein, 375 aa, Spinacia oleracea
  misc_feature (1)..(375): Public GI ID no. 60202574
  misc_feature (231)..(328): Pfam Name: 2OG-FeII_Oxy Pfam Description: 2OG-Fe(II) oxygenase superfamily
  misc_feature (1)..(375): Bit score of 140.8 for HMM based on sequences of Figure 5
  misc_feature (1)..(375): Functional Homolog Of SEQ ID NO. 287
MASTKVVEHLKENVLWKQAIMDRNANISDPPFEETYKNLLLKHNITPLTTTTTTTTTTATIEVRDLPLIDLSRLVATAAKERENCKRDIANASREWGFFQVVNHGIPHRMLEEMNKEQVKVFREPFNKKKGDNCMNLRLSPGSYRWGSPTPNCLSQLSWSEAFHIPMNDICSNAPRNIANGNPNISNLCSTVKQFATTVSELANKLANILVEKLGHDELTFIEEKCSPNTCYLRMNRYPPCPKYSHVLGLMPHTDSDFLTILYQDQVGGLQLVKDGRWISVKPNPEALIVNIGDLFQAWSNGVYKSVVHRVVANPRFERFSTAYFLCPSGDAVIQSYREPSMYRKFSFGEYRQQVQQDVREFGHKIGLSRFLICN

SEQ ID NO: 365 - protein, 323 aa, Vigna angularis
  misc_feature (1)..(323): Public GI ID no. 67077818
  misc_feature (166)..(270): Pfam Name: 2OG-FeII_Oxy Pfam Description: 2OG-Fe(II) oxygenase superfamily
  misc_feature (1)..(323): Bit score of 362.1 for HMM based on sequences of Figure 5
  misc_feature (1)..(323): Functional Homolog Of SEQ ID NO. 287
MVLAARNPMKSEGILPREVPVVDFSGERAEVAKVIVKACEEYGFFKVINHGISKEVIAKSEEAGFGFFGKPMVEKKVAVPAYGCKNIGVNGDMGEVEYLLLSATTDSIAHISKTISTDPLNLRKSLSAYTEAVKELACEILEVMAEGLGVPDTWVFSRLIRDGESDSVLRLNHYPPIINRDKDKSSQITKVGFGEHSDPQILTILRSNDVGGLQISLPDGVWIPVTPDPSAFYVNVGDVLQVMTNGRFVSVRRRAMTNSYKCRMSVAYFGAPPLHQTIVAPSVMVTPQRPSLFRPFTWAEYKKATYSLRLGDTRLQLFRNCKR

SEQ ID NO: 366 - DNA, 1322 bp, Triticum aestivum
  misc_feature (1)..(1322): Ceres Clone ID no. 900331
  misc_feature (1)..(1322): Encodes the peptide sequence at SEQ ID NO. 367
aaaactcaactcgaaaagctctcgcgcttgctcgatcaagccttctcttgccctgctttctcctctgtttcctcgagaacaaggaagaagaaaaagccgaccatggtggtccttgccaagggcgagctggagcagatagcgctgccggcggcccagccgccgctggcccacgtgcgggaggtcgacctgtccgccgccccggggcccggccgcgcggccgcggcgcgcgcgctggtgtccgcgtgcgaggagcagggcttcttcaaggtgaccggccacggggtgccgccggagctcgtgcgcgccgcggaggcggccgcggcggagttcttcgcgctgccgcaggccgagaaggaggccgccgctggccggccgctcgggtacgacagcaagcgcatcggcgtctccggcgacctcgggtggatcgagtacctcatgctgggcgtcacccccgccggcgcgctgcccgccgcctccttcgcgtcctggacattgccgtgcgcaggcgccgccgtcgcgtcgctgtccgagcccccctgccccttacgggatcttctggaggagtacgcggcggcggtgcggcggatggcgtgcggcgtgctggagctgatggcggaggggctggggatcgcgccggcggacgcgctgtcccggctggtggcggacgcggagagcgacagcatgctccgggtgaaccactacccgccgcggccggagctgcagggccgcctcctgacggggttcggcgagcacacggacccgcaggtcatctccgtgctccgctccaacggcacctccgggctggagatctgcgcgcgcgatggctcctgggccgccgtgccgcccgaccccgactccttcttcgtcaacgtcgccgacgccctgcaggtgctgacgaacgggaggttcaggagcgtgaggcacagggtggtggtgagcagcgagaggccgagggtgtccatgatcttcttcggcggcccgccgttcggccagaggctggcgccgctgcgccagctgctaggggacggcggccggagccgctacagggagttcacctggaaggagtacaagagcagcacccacaagggcaggctcgccaccgaccgcctctgcagcttcgagaactagccagcgaccacctgcctgacagactagcttccgtgcgttacgtatatactgcaggctatatacttatgtgtgtgtgtgatgaatgcatgatcatgatcctagttaactaatgaagcccggatattgaaaacggatttgctaaatctcatctactacctccgtccttatttattggtgctttcgctttttgtgtc

SEQ ID NO: 367 - protein, 341 aa, Triticum aestivum
  misc_feature (1)..(341): Ceres Clone ID no. 900331
  misc_feature (192)..(291): Pfam Name: 2OG-FeII_Oxy Pfam Description: 2OG-Fe(II) oxygenase superfamily
  misc_feature (1)..(341): Bit score of 404.5 for HMM based on sequences of Figure 5
  misc_feature (1)..(341): Functional Homolog Of SEQ ID NO. 287
MVVLAKGELEQIALPAAQPPLAHVREVDLSAAPGPGRAAAARALVSACEEQGFFKVTGHGVPPELVRAAEAAAAEFFALPQAEKEAAAGRPLGYDSKRIGVSGDLGWIEYLMLGVTPAGALPAASFASWTLPCAGAAVASLSEPPCPLRDLLEEYAAAVRRMACGVLELMAEGLGIAPADALSRLVADAESDSMLRVNHYPPRPELQGRLLTGFGEHTDPQVISVLRSNGTSGLEICARDGSWAAVPPDPDSFFVNVADALQVLTNGRFRSVRHRVVVSSERPRVSMIFFGGPPFGQRLAPLRQLLGDGGRSRYREFTWKEYKSSTHKGRLATDRLCSFEN

SEQ ID NO: 368 - protein, 403 aa, Oryza sativa
  misc_feature (1)..(403): Public GI ID no. 222630276
  misc_feature (1)..(403): Oryza sativa Japonica Group
  misc_feature (214)..(342): Pfam Name: 2OG-FeII_Oxy Pfam Description: 2OG-Fe(II) oxygenase superfamily
  misc_feature (1)..(403): Bit score of 213.4 for HMM based on sequences of Figure 5
  misc_feature (1)..(403): Functional Homolog Of SEQ ID NO. 287
MVVPSATTPARQETVVAAAPQAAAASGVVGGGGGVTIATVDMSAERGAVARQVATACAAHGFFRCVGHGVQAAAPVAARLDAATAAFFAMAPAEKQRAGPASPLGYGCRSIGFNGDVGELEYLLLHANPAAVAHRARTIDAMDPSRFSEICLHISASEYCSGVMQRSISAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 369 - DNA, 1062 bp, Sorghum bicolor
  misc_feature (1)..(1062): Ceres Annot ID no. 8657905
  misc_feature (1)..(1062): Encodes the peptide sequence at SEQ ID NO. 370
atggtggtcctcgccaagggtgagctcgagcagatcgccctgccggcggcggagccgccgccagccgacgtgcggtcggtggacctgtcggccccggcgggccccgcgcgcgaggccgcagcgcgcgcgctggtggcggcgtgcgaggagcacgggttcttccgggtgacgggccacggcgtgccgccggagctcgtgcgcgccgcggaggccgcggcggccgggttcttcgcgcagccgcaggacgagaaggacgaggaggctcccacgctcgggtacggcagcaagcgcatcggcggcaacggcgacctcgggtgggtcgagtacctcctgctcggcgtcacccccgccggcgccgccgtgccggctgcctccgcgtcctcctcgacattgccgtgcgctgccgccgccgccgccgccaccgcatcgtcgccgtccgcgccggccgggtcggccgggctgttacgggaccttctggacgagtacacggtggcggtgcggcggatggcgtgcgcggtgctggagctgatggcggaggggctgggcatcgccggcggcgccggggacggggacgtgctggcgcggctggtgacgcgcgcggacagcgactgcatgctgcgggtgaaccactacccgccgcggccggcgttgaacccctgcagcctgacggggttcggcgagcacacggacccgcagatcatctcggtgctccgcgccaacggcacctccggcctggagatcgcgctgcgggacggcgcctgggcctccgtcccgcccgacggcgacggcttcttcgtcaacgtcggcgacaccctgcaggtgttgacgaacgggaggttcaggagcgtgaggcacagggtggtggtgaacagcgagaagtcccgggtgtccatggtcttcttcggcgggccgccgccgggcgagaggctggcgccgctgccgcagctgctgggcgacggcggccggagccggtaccgggacttcacctggagcgagttcaagaacagcgggtgcaggaccaggctcgcggaagaccggctgtcccgcttcgagaacaagtag

SEQ ID NO: 370 - protein, 353 aa, Sorghum bicolor
  misc_feature (1)..(353): Ceres Annot ID no. 8657905
  misc_feature (1)..(353): Public GI ID no. 242051631
  misc_feature (203)..(302): Pfam Name: 2OG-FeII_Oxy Pfam Description: 2OG-Fe(II) oxygenase superfamily
  misc_feature (1)..(353): Bit score of 385.3 for HMM based on sequences of Figure 5
  misc_feature (1)..(353): Functional Homolog Of SEQ ID NO. 287
MVVLAKGELEQIALPAAEPPPADVRSVDLSAPAGPAREAAARALVAACEEHGFFRVTGHGVPPELVRAAEAAAAGFFAQPQDEKDEEAPTLGYGSKRIGGNGDLGWVEYLLLGVTPAGAAVPAASASSSTLPCAAAAAAATASSPSAPAGSAGLLRDLLDEYTVAVRRMACAVLELMAEGLGIAGGAGDGDVLARLVTRADSDCMLRVNHYPPRPALNPCSLTGFGEHTDPQIISVLRANGTSGLEIALRDGAWASVPPDGDGFFVNVGDTLQVLTNGRFRSVRHRVVVNSEKSRVSMVFFGGPPPGERLAPLPQLLGDGGRSRYRDFTWSEFKNSGCRTRLAEDRLSRFENK

SEQ ID NO: 371 - protein, 331 aa, Solanum lycopersicum
  misc_feature (1)..(331): Public GI ID no. 126843224
  misc_feature (178)..(280): Pfam Name: 2OG-FeII_Oxy Pfam Description: 2OG-Fe(II) oxygenase superfamily
  misc_feature (1)..(331): Bit score of 594.9 for HMM based on sequences of Figure 5
  misc_feature (1)..(331): Functional Homolog Of SEQ ID NO. 287
MVVLTKPAITHFPIVKNSFKSPSYINDIPVIDLSKANSKNLIVNACEEFGFFKVINHDVPMEFISKLESEAVKFFSSPLSEKLKAGPADPFGYGNKKIGQNGDIGWVEYILLSTNSEFNYQKFASVLGVNPENIRAAVNDYVSSVKKMSCEILEKLAEGLKIQPTNVLSKLLMDEKSDSVFRLNHYPPCPDIQEFNAKNLIGFGEHTDPQIMSILRSNNTSGLQILLKNGNWFSVPSDQNSFFVNVGDSLQVMTNGRFKSVKHRVLTNSVKSRLSMIYFGGPPLSEKIAPLPSLMEGKDSLYKEFTWFEYKKSAYKTRLADNRLVLFEKSL

SEQ ID NO: 372 - DNA, 1285 bp, Zea mays
  misc_feature (1)..(1285): Ceres Clone ID no. 313261
  misc_feature (1)..(1285): Encodes the peptide sequence at SEQ ID NO. 373
gcgctctgtgcacagacgaccttcttcccatcccttcccttccctctgctagtctgcttcgttcctcggccatggtggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcgtgcgaggagcacgggttcttccgggtgacgggccacggcgtgccggccagactcgtgcgcgccgcggaggccgcggcggccgggttcttcgcgcggccacagggcgagaaggaggaggagggccccacgctcgggtacggaagcaagcgcatcggcggcaacggcgacctcggctgggtcgagtacctcctgctcggtggcacacccgccgccgccgcgtcctcctcggcattattgccctgcgccgccgccccgtcgccgtccgcgccggccgggccgttacgggaccttctggacgagtacacggtggcggtgcggcggatggcgtgcgcggtgctggagctgatggcggaggggctgggcatcgccggggacgcgccgcagctggcgcggctggtggcgcgcgcggacagcgactgcatgctgcgggtgaaccactacccgccgcggccggcgctcaaccccagcctcacggggttcggcgagcacaccgacccgcagatcatctcggtgctccgcgccaacggcacctccggcctggagatcgcgctgcgggacggcgcctgggcctccgtcccgcccgacggggacgccttcttcgtcaacgtcggcgacaccctgcaggtgttgacgaacgggaggttcaggagcgtgaggcacagggtggtggtgaacagcgagaagtcccgggtgtccatggtcttcttcggcggcccgccgcccggcgagaggctgggcccgctgccgcagctcctgggcgacggcggccggagccggtaccgggacttcacctggagcgagttcaagaccagcgggtgcaggaccaggctcgcggaagaccgcctgtcccgcttcgagaagaagtagctagaggctacgtcatttgcatgaccggcggtaggatcgattaccatgtatgcttctctgtatatgtcagttgcattgccacagctctagctactggcgcccgtacgtgtatattagtggccatgctcgtattgtacgtgcacgtgtatgcacgcatatacatggtggcaccacacagggtatcatgcatccattgttatctatac

SEQ ID NO: 373 - protein, 335 aa, Zea mays
  misc_feature (1)..(335): Ceres Clone ID no. 313261
  misc_feature (186)..(284): Pfam Name: 2OG-FeII_Oxy Pfam Description: 2OG-Fe(II) oxygenase superfamily
  misc_feature (1)..(335): Bit score of 390.4 for HMM based on sequences of Figure 5
  misc_feature (1)..(335): Functional Homolog Of SEQ ID NO. 287
MVVLAKGELEQIALPAAEPPPADVRSVDLSAPAGPAREAAARALVAACEEHGFFRVTGHGVPARLVRAAEAAAAGFFARPQGEKEEEGPTLGYGSKRIGGNGDLGWVEYLLLGGTPAAAASSSALLPCAAAPSPSAPAGPLRDLLDEYTVAVRRMACAVLELMAEGLGIAGDAPQLARLVARADSDCMLRVNHYPPRPALNPSLTGFGEHTDPQIISVLRANGTSGLEIALRDGAWASVPPDGDAFFVNVGDTLQVLTNGRFRSVRHRVVVNSEKSRVSMVFFGGPPPGERLGPLPQLLGDGGRSRYRDFTWSEFKTSGCRTRLAEDRLSRFEKK

SEQ ID NO: 374 - protein, 321 aa, Cucurbita maxima
  misc_feature (1)..(321): Public GI ID no. 32127337
  misc_feature (165)..(267): Pfam Name: 2OG-FeII_Oxy Pfam Description: 2OG-Fe(II) oxygenase superfamily
  misc_feature (1)..(321): Bit score of 592.2 for HMM based on sequences of Figure 5
  misc_feature (1)..(321): Functional Homolog Of SEQ ID NO. 287
MAAASSFSAAFYSGIPLIDLSAPDAKQLIVKACEELGFFKVVKHGVPMELISSLESESTKFFSLPLSEKQRAGPPSPFGYGNKQIGRNGDVGWVEYLLLNTHLESNSDGFLSIFGQDPQKLRSAVNDYISAVRNMAGEILELMAEGLKIQQRNVFSKLVMDEQSDSVFRVNHYPPCPDLQALKGTNMIGFGEHTDPQIISVLRSNNTSGFQISLADGNWISVPPDHSSFFINVGDSLQVMTNGRFKSVKHRVLTNSSKSRVSMIYFGGPPLSEKIAPLASLMQGEERSLYKEFTWFEYKRSAYNSRLADNRLVPFERIAAS

SEQ ID NO: 375 - protein, 339 aa, Nerium oleander
  misc_feature (1)..(339): Public GI ID no. 51011364
  misc_feature (168)..(287): Pfam Name: 2OG-FeII_Oxy Pfam Description: 2OG-Fe(II) oxygenase superfamily
  misc_feature (1)..(339): Bit score of 380.6 for HMM based on sequences of Figure 5
  misc_feature (1)..(339): Functional Homolog Of SEQ ID NO. 287
MVVATPTPVLNEKITRAVELPMIDLMGERAEVSKLMVKACQEFGFFKLVNHGVSQDVIATMEEESWQFFSRPSSEKERAGPPDPYGYGCKNIGFNGDVGEVEYLMLKANPLSVPPHASNDPTKFSSAVSSYVAAVRELACEILDLIGEGLRVPDTSVFSKLIKDVESDSLLRLNHYPPLHRDRDTSPSSLHHHVRHNPPHQSNSRIGFGEHTDPQILTILKSNAVAGLQISVDEGIWVPVTPHPTAFFVNVGDVLQAMTNGRFTSVRHRAMVNSYESRMSMPYFFSPPLRARISPIPEMVTTQNPRLYRSFTWADYKKATYTQRLGESRLNLYKLQSDE

SEQ ID NO: 376 - protein, 317 aa, uncultured Sphingobacteria
  misc_feature (1)..(317): Public GI ID no. 330752217
  misc_feature (1)..(317): uncultured Sphingobacteria bacterium
  misc_feature (174)..(276): Pfam Name: 2OG-FeII_Oxy Pfam Description: 2OG-Fe(II) oxygenase superfamily
  misc_feature (1)..(317): Bit score of 85.1 for HMM based on sequences of Figure 5
  misc_feature (1)..(317): Functional Homolog Of SEQ ID NO. 287
MSKRTIPVVDLSKFVNGNAAEKQAFVNKVGAAFHEVGFVGIVNHGIPKELVDGFYKASKTFFSQPVATKRQYQVEGLSGQRGYTSFGMEHAKQSQVADLKEFFQMGQFMQREGYDKNEYPDNLDTSETPEFTALGKDLYKAFESSGGHLLRAIAIYLNLDENYFEEKINEGHSILRSIHYPPITEEPRSAIRAEQHEDINLITLLVGASAGGLQLLNTNDEWLDITPGEDEIVINVGDMLQRLTNNYLKSTTHRVVNPPKKQWHVPRLSIPFFLHPKANMDLSCLGECITEERPLQYEPITAGQYLDERLREIGLKK

SEQ ID NO: 377 - protein, 338 aa, Arabidopsis thaliana
  misc_feature (1)..(338): Public ID no. sp_O49561_G2OX8_ARATH
  misc_feature (193)..(290): Pfam Name: 2OG-FeII_Oxy Pfam Description: 2OG-Fe(II) oxygenase superfamily
  misc_feature (1)..(338): Bit score of 125.9 for HMM based on sequences of Figure 5
  misc_feature (1)..(338): Functional Homolog Of SEQ ID NO. 287
MDPPFNEIYNNLLYNQITKKDNDVSEIPFSFSVTAVVEEVELPVIDVSRLIDGAEEEREKCKEAIARASREWGFFQVINHGISMDVLEKMRQEQIRVFREPFDKKSKSEKFSAGSYRWGTPSATSIRQLSWSEAFHVPMTDISDNKDFTTLSSTMEKFASESEALAYMLAEVLAEKSGQNSSFFKENCVRNTCYLRMNRYPPCPKPSEVYGLMPHTDSDFLTILYQDQVGGLQLIKDNRWIAVKPNPKALIINIGDLFQAWSNGMYKSVEHRVMTNPKVERFSTAYFMCPSYDAVIECSSDRPAYRNFSFREFRQQVQEDVKKFGFKVGLPRFLNHVY

SEQ ID NO: 378 - protein, 332 aa, Nicotiana plumbaginifolia
  misc_feature (1)..(332): Public GI ID no. 251821339
  misc_feature (177)..(279): Pfam Name: 2OG-FeII_Oxy Pfam Description: 2OG-Fe(II) oxygenase superfamily
  misc_feature (1)..(332): Bit score of 611.3 for HMM based on sequences of Figure 5
  misc_feature (1)..(332): Functional Homolog Of SEQ ID NO. 287
MVVLTKPGIDHFPIVKNCKSSSFFNGVPLIDLSKPDSKNLIVKACEEFGFFKIINHSVPVEFITKLESEAIKFFSSPLAEKQKAGPADPFGYGNKKIGPNGDVGWVEYILLSTNSEFNYHKFASVLGVNPETIRAAVNDYVSAVKKMACEILEMLAEGLNIHPRNVFSKLLMDEKSDSVFRINHYPPCPEVQQFKDNNLIGFGEHTDPQIISLMRSNNTSGLQILLKNGHWISVPPDPNSFFINVGDSLQVMTNGRFKSVRHRVLANSVKSRLSMIYFGGPPLGEKIAPLASLMEGEESLYEEFTWFEYKKSAYKTRLADNRLVLFEKVAAS

SEQ ID NO: 379 - protein, 335 aa, Populus alba
  misc_feature (1)..(335): Public GI ID no. 37544101
  misc_feature (1)..(335): Populus alba x Populus tremuloides
  misc_feature (170)..(280): Pfam Name: 2OG-FeII_Oxy Pfam Description: 2OG-Fe(II) oxygenase superfamily
  misc_feature (1)..(335): Bit score of 386.5 for HMM based on sequences of Figure 5
  misc_feature (1)..(335): Functional Homolog Of SEQ ID NO. 287
MVVASPTQIHGEKLLAIELPVIDLSGERSMVSNLIVKACEEYGFFKVRNHGVPHDIIARMENESSNFFAKTFDEKQKAGLANSFGYGCKNIGFNGDTGEVEYLLFNTNPLSIAERSKTISNDPTEFSSAMSGYIEAVRELACELLDLMAEGLWVPDRSVFSRLIRDDDSDSIIRLNHYPPMPILCKDKDSSSPCNHNRVGFGEHSDPQILTILRSNDVGGLQISLNDGVWVPVTPDPSAFCVNVGDLLQAMTNGRFVSVRHKALTNSYKSRMSMAYFAAPPLNARIAVPPEMVTPIKPALYRPFSWAEFKKAAFALRLGDSRLGLFRMEEYEQVA

SEQ ID NO: 380 - protein, 339 aa, Vitis vinifera
  misc_feature (1)..(339): Public GI ID no. 225432055
  misc_feature (170)..(281): Pfam Name: 2OG-FeII_Oxy Pfam Description: 2OG-Fe(II) oxygenase superfamily
  misc_feature (1)..(339): Bit score of 398.2 for HMM based on sequences of Figure 5
  misc_feature (1)..(339): Functional Homolog Of SEQ ID NO. 287
MVVASPTPIGSEKLIAVEVPIIDLAARGPKVAELIVKASQEFGFFKVINHGVPEDVIRKMEEESFNFFGKPDSEKKKAGPAQPFGYGCKNIGFNGDMGEVEYLLFNTNPHCISQRSETISNDPTKFSSAVSGYIQAVTDLACEILDLMAEGLWVQNTSVFSSLITHLDSDSVFRLNHYPPPLKDRDTSPSSSFQIHHQGNNIGFGEHSDPQILTILRSNDVGGLQICLGDGVWVPVPPDPTSFCVNVGDLLQAMTNGRFVSVRHRALTNSDKPRMSMAFFGAPPLHALITSPPEVVTPERPSLYRPFTWAEYKEITYSLRLGDSRLNLFKACPDKEAQE

SEQ ID NO: 381 - DNA, 1565 bp, Triticum aestivum
  misc_feature (1)..(1565): Ceres Clone ID no. 1076347
  misc_feature (1)..(1565): Encodes the peptide sequence at SEQ ID NO. 382
gtagcaccgcgattcgccatagccactgcccagcgagcggcccagtggtagctaagctgagcgagtgagtgtgcactgcgtgtgacacgacgaccggttggcccatcactagcgcgctagctagacgtacgcacgcacgtgtctacgctacctatctctctctccgtcgaccgaccatgccggccttcgccgagccagccattgatccgccgctggcggacagctaccgcgcgctgctgcgcagcgaccagctccgccgcggcggcattgcgccggcgccggcgtcggagagcgtggccgtgcttgagcgcgccctgccgatgatcgacttgaagcgcctgacgagcggcgacgcgggggagaggaaggcgtgcgcggacgccatggcgaccgcggcgtcggagtggggcttcttccaggtgatcaaccacgacgtggggcgggagctcctggaggagatgcggcgcgagcaggcgcggctgttccgcctgccgttcgacaccaaggagaaggccgggctcctcaacggctcgtaccggtggggcaacccgacggctacgtcgctccggcacctctcgtggtcggaggccttccacgttccgctcgccagcatctcccgggaggactgcgactacgggaagctcagctccttgaggggcgtgatgcaggaggtggcggacgcgatgtcgcgtgtggcggacacggtggcggcggtgctggcggaggacctcgggcacgatgcggggggcggcgagccggcgttcccggcggggtgcgacgggacgacgtgcttcctgcggctcaacaggtacccggcgtgcccgttcgcgccggacacgttcgggctggtgccgcacacggacagcgacttcctcaccatcctctgccaggaccaggtcgggggcctgcagctcatgaaggactcccgctgggtcgccgtgaaaccccgctccgacgcgctcatcgtcaacatcggcgatctgtttcaggcgtggagcaacaacaggtacaagagcgtggagcacaaagtggtggccaacgccaaggcggagcgcctctccgtcgcctacttcctgtgcccgtcgtacgactcgccggtcggcacatgcggcgagccgtccccgtacaggccgttcaccttcggggagtaccggaggaaggtgcaggacgatgtcaagagaaccggcaaaaagattgggctccccaactttctcaaacagtctcccgttgacgccatgaatcacggcctctgtttttaacacgtactcaaatctcaccgtagaagcgtcgtgcgcccgcagtatggaatcggagataatttcccttttttttagttctttctatttctattctagttttgtttcgccccttttgggcctaggtgataggtactataccacgagataatgatggaggaatcaatggaatatataacatgatgctatggtgatacgtctgcccatctgctcccgtttgtttgttcctcgttccttcttttcgtcttgtcgtgcgtactacgaggaacaaacgtggacggacgagcacctaagcttcaacgttgtttc

SEQ ID NO: 382 - protein, 360 aa, Triticum aestivum
  misc_feature (1)..(360): Ceres Clone ID no. 1076347
  misc_feature (207)..(302): Pfam Name: 2OG-FeII_Oxy Pfam Description: 2OG-Fe(II) oxygenase superfamily
  misc_feature (1)..(360): Bit score of 124.2 for HMM based on sequences of Figure 5
  misc_feature (1)..(360): Functional Homolog Of SEQ ID NO. 287
MPAFAEPAIDPPLADSYRALLRSDQLRRGGIAPAPASESVAVLERALPMIDLKRLTSGDAGERKACADAMATAASEWGFFQVINHDVGRELLEEMRREQARLFRLPFDTKEKAGLLNGSYRWGNPTATSLRHLSWSEAFHVPLASISREDCDYGKLSSLRGVMQEVADAMSRVADTVAAVLAEDLGHDAGGGEPAFPAGCDGTTCFLRLNRYPACPFAPDTFGLVPHTDSDFLTILCQDQVGGLQLMKDSRWVAVKPRSDALIVNIGDLFQAWSNNRYKSVEHKVVANAKAERLSVAYFLCPSYDSPVGTCGEPSPYRPFTFGEYRRKVQDDVKRTGKKIGLPNFLKQSPVDAMNHGLCF

SEQ ID NO: 383 - protein, 323 aa, Nicotiana tabacum
  misc_feature (1)..(323): Public GI ID no. 46849531
  misc_feature (168)..(270): Pfam Name: 2OG-FeII_Oxy Pfam Description: 2OG-Fe(II) oxygenase superfamily
  misc_feature (1)..(323): Bit score of 580.0 for HMM based on sequences of Figure 5
  misc_feature (1)..(323): Functional Homolog Of SEQ ID NO. 287
MDQHFSKDNCKPTSFFNNVPLIDLSKPDSKNLIVKACEEFGFFKVINHSVPTEFITKLSEAIKFFSSPLSEKEKAGPPDPFGYGNKQIGCNGDSGWVEHILVSTNSEFNYYKFASILGVNPENIRAAVNDYVSAVKKMACEILEMLAEGLKIHPRNVFSKLLMDEKSDSVFRLNHYPPCTEIQQFNDNNLIGFGEHTDPQIISVLRSNNTSGLQILLKNGHWISVPPDPNSFFVNVGDSLQVMTNGKFKSVKHRVLANSMKSRLSMIYFGGPPLSEKIAPLASLMEGEDSLYKEFTWFEYKKSAYKTRLADNRLILFEKIAAS

SEQ ID NO: 384 - protein, 332 aa, Vitis vinifera
  misc_feature (1)..(332): Public GI ID no. 225468310
  misc_feature (177)..(279): Pfam Name: 2OG-FeII_Oxy Pfam Description: 2OG-Fe(II) oxygenase superfamily
  misc_feature (1)..(332): Bit score of 598.6 for HMM based on sequences of Figure 5
  misc_feature (1)..(332): Functional Homolog Of SEQ ID NO. 287
MVVLSKPTIADFPPIINCKSTTLFPVIPTVDLSEPDSKHLVVKSCEEFGFFKVINHGIPLELISRLETEVIEFFSLSLSEKQKAGPPDPFGYGNRSIGPNGDVGWVEYLLLTMNQERNSQKLATIFGKYPEKLCSALNDYVLAVKKMACELLELMADGLRIKPRNVFSKLLMDEQSDSVFRLNHYPPYSELQASNGKNMIGFGEHTDPQIISVLRSNNTSGLQISLGNGSWISVPPDANSFFINVGDSLQVMTNGRFKSVRHRVLANSIKSRISMIYFGGPPLNEKIAPLPSLVEGKESLYKEFTWFEYKRSAYKSRLGDNRLSQFERTAAT

SEQ ID NO: 385 - DNA, 999 bp, Populus trichocarpa
  misc_feature (1)..(999): Ceres Annot ID no. 1441748
  misc_feature (1)..(999): Encodes the peptide sequence at SEQ ID NO. 386
atggtgcttatatccaagccagctcttgaacagttctcgtttataagaaacagaaaacctaccacagttttttctggaatccctctaatagacctctcaaaacctgactccaagcacctactggttgaggcatgcgaggaatttggatttttcaaggtaatcaaccatggagtgcctatggaattcatatccaagctggaatctgaagctgtcaatttcttctcattaccgctctctgagaaagaaaaagtaggccctcctagcccctttggctatggtaacaaaagcattggacaaaatggtgatgtgggctgggtagaataccttctcttaaccactaatcaagaatcaatttctcagaggttctcttcagtttttggtgacaacccagaaaagtttcggtgtgctttaaatgattatgtatcagctgtgaagaaaatggcatgtgagattcttgaaatgatggctgatggtctaaaacttcaacaaagaaatgtgtttagtaaacttttgatggatgaacagagtgactctgtttttaggctaaatcactaccctccatgcccagaaattgaagcattgactgaccaaaacatgattggatttggagagcatacagacccacaaatcatttctgtgttaagatccaacaacacttctggcctgcaaatctctctcagtgatggcagctggatttcagttccacctgatcagaactcattttttgtcaatgttggtgactcattacaggttatgactaatgggaggtttaagagtgtcaggcacagggttttgaccaacagcatgaaagctagagtttcaatgatttattttggtggaccacctttgagtgagaaaatagctccattgccctcgctcataaaaggaaaggaaagcttgtacaaagaatttacatggttcgagtacaaaagatctgcctacagctccagattggctgataataggcttgtcctctttgagagaatagcagcctcgtaa

SEQ ID NO: 386 - protein, 332 aa, Populus trichocarpa
  misc_feature (1)..(332): Ceres Annot ID no. 1441748
  misc_feature (177)..(279): Pfam Name: 2OG-FeII_Oxy Pfam Description: 2OG-Fe(II) oxygenase superfamily
  misc_feature (1)..(332): Bit score of 622.0 for HMM based on sequences of Figure 5
  misc_feature (1)..(332): Functional Homolog Of SEQ ID NO. 287
MVLISKPALEQFSFIRNRKPTTVFSGIPLIDLSKPDSKHLLVEACEEFGFFKVINHGVPMEFISKLESEAVNFFSLPLSEKEKVGPPSPFGYGNKSIGQNGDVGWVEYLLLTTNQESISQRFSSVFGDNPEKFRCALNDYVSAVKKMACEILEMMADGLKLQQRNVFSKLLMDEQSDSVFRLNHYPPCPEIEALTDQNMIGFGEHTDPQIISVLRSNNTSGLQISLSDGSWISVPPDQNSFFVNVGDSLQVMTNGRFKSVRHRVLTNSMKARVSMIYFGGPPLSEKIAPLPSLIKGKESLYKEFTWFEYKRSAYSSRLADNRLVLFERIAAS

SEQ ID NO: 387 - protein, 326 aa, Ananas comosus
  misc_feature (1)..(326): Public GI ID no. 223953574
  misc_feature (177)..(278): Pfam Name: 2OG-FeII_Oxy Pfam Description: 2OG-Fe(II) oxygenase superfamily
  misc_feature (1)..(326): Bit score of 535.6 for HMM based on sequences of Figure 5
  misc_feature (1)..(326): Functional Homolog Of SEQ ID NO. 287
MVVLAHGELEQISLPVVHKPTNFFSDVPVIDLSDPESKARLIGACEELGFFKVTNHGIPMELMAKLEDEALRFFSLPQVEKELSASSPGPFGYGSKKIGGNGDLGWVEYILLEITSKPISHSSLSFLKEPSASFSVLNEYITAVRKLACEVLELMAESLKIQPKNVFSKLVTDSESDSMLRLNHYPPCPHLQGLDCGLTGFGEHTDPQIISLLRSNNTSGLEISLRDGSWVSVPPDQSSFFINVGDSLQVLTNGRFRSVKHRVLANSAQSRVSMIYFGGPSPRERLAPLPLLIEEGKQSLYREFTWCEYKRSAYKTRLSDNRLGQF

SEQ ID NO: 388 - protein, 327 aa, Pisum sativum
  misc_feature (1)..(327): Public GI ID no. 49035759
  misc_feature (174)..(276): Pfam Name: 2OG-FeII_Oxy Pfam Description: 2OG-Fe(II) oxygenase superfamily
  misc_feature (1)..(327): Bit score of 555.5 for HMM based on sequences of Figure 5
  misc_feature (1)..(327): Functional Homolog Of SEQ ID NO. 287
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQDHNFSLYGEDIDKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 389 - protein, 340 aa, Triticum aestivum
  misc_feature (1)..(340): Public GI ID no. 327179113
  misc_feature (175)..(279): Pfam Name: 2OG-FeII_Oxy Pfam Description: 2OG-Fe(II) oxygenase superfamily
  misc_feature (1)..(340): Bit score of 513.9 for HMM based on sequences of Figure 5
  misc_feature (1)..(340): Functional Homolog Of SEQ ID NO. 287
MVVLAKPAALEQITLLRTPEPWESFSGIPAVDLSGPDAAADVVRACERFGFFSVVNHGVPAGVVDRLEAEAVRFFASSQAEKDASGPADPFGYGSKRIGRNGDMGWVEYLLLAIERDALSKASPAPTSALRDAINAYVGAMRGLARTVLEMVAEGLGVSPRGALADMVTGDVASDQVFRLNHYPPCPLLQGLPPNCSVTGFGEHTDPQLVSILHSNGTPGLQVALHDGRWVSVPPNRDAFFVNVGDSLQVLTNGRLRSVRHRVVAGNGLKSRVSMIYFGGPPLAQRIAPLPQLLAGTPLYREFTWGEYKKAAYRSRLGDNRLAPFETPLVAMAHADHHRS

SEQ ID NO: 390 - DNA, 1034 bp, Glycine max
  misc_feature (1)..(1034): Ceres Clone ID no. 1239118
  misc_feature (1)..(1034): Encodes the peptide sequence at SEQ ID NO. 391
acaagcatccttgctcagagcctcattaagttttttctcctatacttattcattgactctccaaaagccctttaaacctctctattcctctctcacgtaccctcttccttccattcactccacttcttaactccccaaaacagaaagcagcaagaaaaatggtgttgctgtccaaggcaacaacagaacaatactcctacatcaagaactacatgccaacggcattctcctcaacaattcccatagtggacctctccaaaccagatgcaaagaccctcatagtgaaggcttgtgaggaatttggattcttcaaagtcatcaaccatggtgttcccatggaaactatatcccagttggaatctgaagccttcaagttcttctctatgccactcaatgagaaggaaaaagtaggccctcccaaaccatatgggtatggtagcaagaaaattggacacaatggggatgttggttgggttgagtaccttcttctcaacaccaatcaagaacacaacttctctgtttatggcaaaaacgctgagaaatttaggtgtttgttgaacagttacatgtcttctgtgaggaaaatggcatgtgagattcttgagctgatggcagaaggattgaagattcaacaaaaaaatgtgtttagcaagcttcttatggataaagagagtgactctgtttttagggtgaatcactaccctgcttgccctgaacttgtgaatggtcaaaacatgatagggtttggagaacacacggacccacaaatcatttctctacttaggtccaacaatacttcaggccttcagatttttcttagagatggaaactggatttcagtcccacctgatcacaaatctttcttcataaatgttggtgattctcttcaggtacaacacaaagcatacaattggttcatactgaaaagttaaatgaaaaacaatcatttcctttatgactttcttatttctttggataagtaaaaaaagaaagtaaagaataaatacaaactcttctttttaagtacccttttg

SEQ ID NO: 391 - protein, 257 aa, Glycine max
  misc_feature (1)..(257): Ceres Clone ID no. 1239118
  misc_feature (173)..(246): Pfam Name: 2OG-FeII_Oxy Pfam Description: 2OG-Fe(II) oxygenase superfamily
  misc_feature (1)..(257): Bit score of 411.6 for HMM based on sequences of Figure 5
  misc_feature (1)..(257): Functional Homolog Of SEQ ID NO. 287
MVLLSKATTEQYSYIKNYMPTAFSSTIPIVDLSKPDAKTLIVKACEEFGFFKVINHGVPMETISQLESEAFKFFSMPLNEKEKVGPPKPYGYGSKKIGHNGDVGWVEYLLLNTNQEHNFSVYGKNAEKFRCLLNSYMSSVRKMACEILELMAEGLKIQQKNVFSKLLMDKESDSVFRVNHYPACPELVNGQNMIGFGEHTDPQIISLLRSNNTSGLQIFLRDGNWISVPPDHKSFFINVGDSLQVQHKAYNWFILKS

SEQ ID NO: 392 - protein, 403 aa, Oryza sativa
  misc_feature (1)..(403): Public GI ID no. 125550923
  misc_feature (1)..(403): Oryza sativa Indica Group
  misc_feature (214)..(342): Pfam Name: 2OG-FeII_Oxy Pfam Description: 2OG-Fe(II) oxygenase superfamily
  misc_feature (1)..(403): Bit score of 213.4 for HMM based on sequences of Figure 5
  misc_feature (1)..(403): Functional Homolog Of SEQ ID NO. 287
MVVPSATTPARQETVVAAAPPAAAASGVVGGGGGVTIATVDMSAERGAVARQVATACAAHGFFRCVGHGVPAEEPVAARLDAATAAFFAMAPAEKQRAGPASPLGYGCRSIGFNGDVGELEYLLLHANPAAVAHRARTIDAMDPSRFSEICLHISASEYCSGVMQRSISAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 393 - protein, 347 aa, Hordeum vulgare
  misc_feature (1)..(347): Public GI ID no. 326520938
  misc_feature (1)..(347): Hordeum vulgare subsp. vulgare
  misc_feature (207)..(302): Pfam Name: 2OG-FeII_Oxy Pfam Description: 2OG-Fe(II) oxygenase superfamily
  misc_feature (1)..(347): Bit score of 123.2 for HMM based on sequences of Figure 5
  misc_feature (1)..(347): Functional Homolog Of SEQ ID NO. 287
MPAFAESTAEPPLSDSYYALLRRGNKVDECASVPPPGCQVLPVAECELPMIDVGCLTTGGGGEEERAACAAAIASAAAEWGFFQVVNHGVKQELLEAMRREQVRLFRLPFEAKATAGLLNDSYRWGSPTATSPRQLSWSEAFHVPLAGISGSPCSYGELTSIRDVTQEVAKAMSKLANTLARVLAESLGHTAGQGFPEGCDESTCFLRLNRYPACPFSPDAFGLVPHTDSDFLTVLCQDQVGGLQLMKGSRWVAVKPIPNALIVNIGDLFQAWSNNRYKSVEHKVITNATTERYSLAYFLCPSYDSPIGACEEPSPYRTFTFGEYRRRVQEDVKKTGKKIGLPNFLL

SEQ ID NO: 394 - protein, 338 aa, Arabidopsis lyrata
  misc_feature (1)..(338): Public GI ID no. 297804032
  misc_feature (1)..(338): Arabidopsis lyrata subsp. lyrata
  misc_feature (193)..(290): Pfam Name: 2OG-FeII_Oxy Pfam Description: 2OG-Fe(II) oxygenase superfamily
  misc_feature (1)..(338): Bit score of 123.8 for HMM based on sequences of Figure 5
  misc_feature (1)..(338): Functional Homolog Of SEQ ID NO. 287
MDPPFNEIYKTLLYNQITNTERDVPEIPFSFSVTAVFEEVELPVIDVSRLIHGAEKERENCKEEIARASREWGFFQVINHGISMDVLEKMRQEQIRVFREPFDKKSKSEKFSAGSYRWGTPSATCLRQLSWSEAFHVPMTDISNNKDFTTLSSTMEKFASEAEALAYMLAEVLAEKSGQKSSFFKENCVRNTCYLRMNRYPPCPKPSEVYGLMPHTDSDFLTILYQDQVGGLQLIKDDRWIAVKPNSRALIINIGDLFQAWSNDMYKSVEHRVMTNPTVERFSTAYFMCPSYDAVIECSSDCPAYRNFSFREFRQQVQEDVKKLGFKVGLPRFLNHLY

SEQ ID NO: 395 - protein, 337 aa, Spinacia oleracea
  misc_feature (1)..(337): Public GI ID no. 27261177
  misc_feature (180)..(285): Pfam Name: 2OG-FeII_Oxy Pfam Description: 2OG-Fe(II) oxygenase superfamily
  misc_feature (1)..(337): Bit score of 519.7 for HMM based on sequences of Figure 5
  misc_feature (1)..(337): Functional Homolog Of SEQ ID NO. 287
MVVLSHVALDQFMKTCKPIDTHLFPTVIPTIDLNSPDVKSLIVKACKEFGFFKVVNHGVPIEMTRQLEDEASKFFSLPQGLKESAGNPNPFGYGNKKIGRNGDVGWIEYLLLSASDEFISQTCLSIYPDNPDVFRCALNNYISKMKKMGVRVLETMAEGLNLKGEDRYALSNLIKDSKSDSYFRLNHYPPRPEAFEGINGRNLVGFGEHTDPQIISVLRSNKIGGLQISLNDGTWVSVPPDDNSFFILVGDSLQVMTNGRFKSVKHRVLADNMKSRLSMIFFAGPPLCQKIAPLPCIMQKGEESLYEEFTWCEYKKSAYKSRLSENRLLRFVKRNHN

SEQ ID NO: 396 - protein, 320 aa, Frankia
  misc_feature (1)..(320): Public GI ID no. 312196334
  misc_feature (1)..(320): Frankia sp. EuI1c
  misc_feature (178)..(282): Pfam Name: 2OG-FeII_Oxy Pfam Description: 2OG-Fe(II) oxygenase superfamily
  misc_feature (1)..(320): Bit score of 48.2 for HMM based on sequences of Figure 5
  misc_feature (1)..(320): Functional Homolog Of SEQ ID NO. 287
MTTPDFPLLDIRRWRDGTGDQRYRFACELDVALRQSGFLLVGGHGISARLRADIRACAARFFRLPREAKSPYVTRVGGRGWIPVGGEANAFYGEVADATRADLKETLTFGRAFATGDPELDDRWFAPNVWPGECPELQAMCERFAAEVRALYDDLLRICAVAFGLPEGWFVDRVQAGPHSLNINRYLPRSETGAPRDHQYRVAPHTDWGVLTVLDRQPGYGGLQVQTRDGRWMDAPYEPDALTVNVGDLLARWTGDRWRSTRHRVLPPPAEAPDEELLSLIVFLESDLDAIVEPLVAGTAYPPVMASTYLLERASAATVA

SEQ ID NO: 397 - protein, 370 aa, Oryza sativa
  misc_feature (1)..(370): Public GI ID no. 23491590
  misc_feature (1)..(370): Oryza sativa Japonica Group
  misc_feature (188)..(306): Pfam Name: 2OG-FeII_Oxy Pfam Description: 2OG-Fe(II) oxygenase superfamily
  misc_feature (1)..(370): Bit score of 336.9 for HMM based on sequences of Figure 5
  misc_feature (1)..(370): Functional Homolog Of SEQ ID NO. 287
MVVPAAAAPECGRREAAAAAAAAVFCRRGRGVVVPTVDMSAPAGRGELSRQVARACAGSGFFRAVNHGVPPRVSAAMDAGAAAFFARAGAEKQLAGRPTPLGYGSRSIGANGDVGELEYLILHASPDAVARKASAIDREDPRRFSQVVNDYVEAVRQLACHVLDLLGEGLGLRDPTSLTRLITATDNDSLIRINHYPPSCAAAAGDHKSGGGPAPTAAIGFGEHTDPQILSVLRANDADGLQLLLPDAAAAGDSVWVPVPPDPSAFFVNVGDLLQALTNGRLVSIRHRVVVGTGKPRLSTIYFAAPPLHARISALPETVAAGAPRRYRAFTWAEYKRTMYTLRLSHNRLDLFHAGDGDGDAGVGDDDDHE

SEQ ID NO: 398 - protein, 390 aa, Physcomitrella patens
  misc_feature (1)..(390): Public GI ID no. 168024874
  misc_feature (1)..(390): Physcomitrella patens subsp. patens
  misc_feature (232)..(325): Pfam Name: 2OG-FeII_Oxy Pfam Description: 2OG-Fe(II) oxygenase superfamily
  misc_feature (1)..(390): Bit score of 176.7 for HMM based on sequences of Figure 5
  misc_feature (1)..(390): Functional Homolog Of SEQ ID NO. 287
MGVSEMNRTEDCVDADIVMKEPEVETATIPTYTMQALWDKKLSLKDFEVSGEDKPTLPYDVFEQDEVLPIIDLQALLGNDKDARYVNLARMLEAAKTWGFFKIRNHGVALETVKKVEQNVKKFFALPMEKKLQVKAVNFVFGYIGGSPVSWKNKWWLESLHMKVQEEAIRKMVALVWSDNPKFADEFMSALTRYYSSMRELSRLIVECLTEGLGLPPNTYTKLETPDAICNARVNHYPACPDPSKVFGIPSHTDPQMLSILYQDDVGGLQVLRNGKWIGIRPDDSTLVVNLGDTFMAITNGILHSAVHRVALNTTRSRYSTIYFYGVDNAAPLSVPPELITEDRPLLYRPFTVNEYRAILTEHQVPDDGIKFLRIQPGVTATARKKMFRR

SEQ ID NO: 399 - protein, 320 aa, Petunia x hybrida
  misc_feature (1)..(320): Public GI ID no. 261863286
  misc_feature (1)..(320): Public GI ID no. 261863286
  misc_feature (165)..(266): Pfam Name: 2OG-FeII_Oxy Pfam Description: 2OG-Fe(II) oxygenase superfamily
  misc_feature (1)..(320): Bit score of 585.5 for HMM based on sequences of Figure 5
  misc_feature (1)..(320): Functional Homolog Of SEQ ID NO. 287
MVILSKPKDPLFPGVPLIDLSKPDSKNLIVKACEEFGFFKVINHGVSTEFISKLESEAIKFFSSPLSEKEKAGPADPFGYGNKTIGHNGDVGLVEYILLSTNTEFNYQKFASILGVNPETIRAAVNDYVTAVKKMACEILEMLAEGLKIHQRNVFSKLLMDEKSDSVFRVNHYPPCTEVQESSGSLIGFGEHTDPQIISVLRSNNTSGLQILLKDGHWISVPPDQNSFFVNVGDSLQVMTNGRFKSVKHRVLANSMKSRLSMIYFGGPPLSEKIAPLASLMEGEDSSLYKEFTWFEYKKSAYKTRLADSRLVLFEKIAAS

SEQ ID NO: 400 - protein, 333 aa, Nicotiana tabacum
  misc_feature (1)..(333): Public GI ID no. 134303284
  misc_feature (179)..(281): Pfam Name: 2OG-FeII_Oxy Pfam Description: 2OG-Fe(II) oxygenase superfamily
  misc_feature (1)..(333): Bit score of 591.4 for HMM based on sequences of Figure 5
  misc_feature (1)..(333): Functional Homolog Of SEQ ID NO. 287
  misc_feature (312)..(312): Xaa is any aa, unknown, or other
MVVLSIPAVEQFSIVKNCKPISSFFPSNIPIIDISKPDSKNLLVKAYEEFGFFKIINHGVPMEFINNLELEAIKFFSSPLNQKEKAGPADPFGYGNRKIGTNGDIGWVEYILLSTNSEFNYQKFASILGLDPENIRVAVNDYVSAMKKMACEILEMLAEGLKIYPKNVFSKLLMDEQSDSVFRINHYPPCPEVQEFNGRNLIGFGAHTDPQIISLLRSNNTSGLQISLEDGHWISVPPDQNSFFINVGDSLQVMTNGRFKSVKHRVLANSLKSRLSMIYFGGPPLSEKIAPLASLIKGDQDSLYKEFTWFEXKKSAYNSRLADNRLVLFEKVL

SEQ ID NO: 401 - DNA, 1277 bp, Gossypium hirsutum
  misc_feature (1)..(1277): Ceres Clone ID no. 1856391
  misc_feature (1)..(1277): Encodes the peptide sequence at SEQ ID NO. 402
gttcatgtacccttcattgcaaacctcttatcaatctcaatatccatccatacccccacattgaataacataaacaactgacaatggtggtggtgtcaaaaccagcaattgaacagttctcttcttacctgaaaaacaacaaaccaaccacattgttcactcaaatcccacttgtagacctctcaaaacctgattcaaaacaccaaataatcaaagcttgtgaagagtttgggttcttcaaggtgatcaaccatggggttccaatggaatccatttccgtgttggaatccgaagctaccaagttcttcagtttaccactttgtgagaaacaaaaaacaggacaaactcaaccttatggctatggtcataaaaggattggtacacaaggtgatgttggttgggttgagtatcttcttttgactactaatcaagaccccagtctccatagcttccaaactttgagggtggctttgaataattatatgaaatcagtaaagaaaatggcgtgtgagatacttgaaatgatggctgatgggttgaagatacaacccaggaatgtgttgagcaagctgttgatggatgaagagagtgactctgttttcagggtgaatcattacccaccatgccctaatgttcaacctttgagtggtaatggcaatggcaatggggatgtgattggatttggtgaacacactgatccacaaattatctcagtgttgagatctaacaacacttctggtcttcaaatctctctaagagaaggaagctggatttcagtgccacctgaccaaacctcattcttcatcaatgttggtgactccttacaggtaatgaccaatggaaggtttaaaagtgtaaaacatagggtagtgaccaacagtgtgaaatcaaggctatcaatgatttattttggtggaccaccattgagtgagaaaatagcacctttgccatctttgatgagaggtgatcaacaaagcttatataaagaatttacttggttcgagtacaagaaatctgcttataattccagattggcagataataggctcattcactttgaaaaaattgctgcttcttaatctctttttttatttttcacttttgagtagattttttttatacttcaaataaaaaaataggattaggaaaaagtttgtagtatcaaaaaggcttgtgtgatctttaggtagctcttttcctttgtactttttttttcttaattttgtttcaactcaatgtaactatccttcttgttaatatagtacaaattttcatcc

SEQ ID NO: 402 - protein, 331 aa, Gossypium hirsutum
  misc_feature (1)..(331): Ceres Clone ID no. 1856391
  misc_feature (170)..(277): Pfam Name: 2OG-FeII_Oxy Pfam Description: 2OG-Fe(II) oxygenase superfamily
  misc_feature (1)..(331): Bit score of 577.9 for HMM based on sequences of Figure 5
  misc_feature (1)..(331): Functional Homolog Of SEQ ID NO. 287
MVVVSKPAIEQFSSYLKNNKPTTLFTQIPLVDLSKPDSKHQIIKACEEFGFFKVINHGVPMESISVLESEATKFFSLPLCEKQKTGQTQPYGYGHKRIGTQGDVGWVEYLLLTTNQDPSLHSFQTLRVALNNYMKSVKKMACEILEMMADGLKIQPRNVLSKLLMDEESDSVFRVNHYPPCPNVQPLSGNGNGNGDVIGFGEHTDPQIISVLRSNNTSGLQISLREGSWISVPPDQTSFFINVGDSLQVMTNGRFKSVKHRVVTNSVKSRLSMIYFGGPPLSEKIAPLPSLMRGDQQSLYKEFTWFEYKKSAYNSRLADNRLIHFEKIAAS

SEQ ID NO: 403 - protein, 330 aa, Sorghum bicolor
  misc_feature (1)..(330): Public GI ID no. 242054465
  misc_feature (176)..(279): Pfam Name: 2OG-FeII_Oxy Pfam Description: 2OG-Fe(II) oxygenase superfamily
  misc_feature (1)..(330): Bit score of 529.8 for HMM based on sequences of Figure 5
  misc_feature (1)..(330): Functional Homolog Of SEQ ID NO. 287
MVVLANPPVVDQIPLLRSPGPRDTFSGVPVVDLSSPAAARAIVDACERFGFFKVVNHGVPAATMGRAESEAVRFFAQAQADKDRAGPAYPFGYGSKRIGLNGDMGWLEYLLLAVDSASLSDACPVPSTAAFRSALNEYVAAVRKVAVRVLEAMAEGLGIADAAALSSMVTGAGGDQVFRVNHYPPCPALQGLGCSATGFGEHTDPQLISVLRSNGTSGLQIALRDGAQWVSVPSDRDAFFVNVGDSLQVLTNGRFKSVKHRVVTNSLKSRVSFIYFAGPALEQRIVPLPELLAEGEESLYKEFTWGEYKKAAYKTRLGDNRLAQFEKRSI

SEQ ID NO: 404 - protein, 346 aa, Lolium perenne
  misc_feature (1)..(346): Public GI ID no. 157382968
  misc_feature (194)..(296): Pfam Name: 2OG-FeII_Oxy Pfam Description: 2OG-Fe(II) oxygenase superfamily
  misc_feature (1)..(346): Bit score of 409.0 for HMM based on sequences of Figure 5
  misc_feature (1)..(346): Functional Homolog Of SEQ ID NO. 287
MVVLAKAELEQIALPAAAPPTADVRAVDLSAAPGAGRAAAARALVAACEEQGFFKVTGHGVPQELVRAVEAAAAGFFELPQAEKEGGAGEPVGYGCKQIGDGGDLGWIEYLLLCLTSTGTVPAASFPFSTLPCAAAAAAAASLSEPSSPLRELLEEYAAAVRQMACAVLELMAEGLGIEPADALSRLVADAESDNMLRVNHYPPAPRPEQQAGRLLTGFGEHTDPQIISVLRSNGTTGLEIAGRDGACASVPPDADSFFINVGDALQVLTNGRFRSVKHRVVVSSERSRVSMIFFGGPPPGEMLAPLPQLLGDGSRSRYREFTWKEYKSSSHKGRLVDNRLCHFEN

SEQ ID NO: 405 - protein, 329 aa, Arabidopsis thaliana [sequence omitted]

SEQ ID NO: 406 - protein, 308 aa, Rumex palustris
  misc_feature (1)..(308): Public GI ID no. 109729789
  misc_feature (152)..(254): Pfam Name: 2OG-FeII_Oxy Pfam Description: 2OG-Fe(II) oxygenase superfamily
  misc_feature (1)..(308): Bit score of 548.5 for HMM based on sequences of Figure 5
  misc_feature (1)..(308): Functional Homolog Of SEQ ID NO. 287
MALFPLIPVIDLSKPDAKHQIVKACEDFGFFKVINHGVPMDSIKKLESEAVKFFSLPLSEKEKAGPPYPVGFGYGNKRIGLNGDVGWVEYLLMTTKSNPEIGDNPEDFRCAMNQYVAAVKSMACDVLELMADGLRIQQKDVFSKLLMDEQSDSMFRVNHYPPYPELQGFKDRNLVGFGEHTDPQIISVLRSNNTSGLEISLRDGSWVSVPPDQTSFFINVGDSLQVMTNSKFKSVRHRVLANSYKSRVSMIYFGGPPMSERIAPLPSLMGVEQTSLYKEFTWYEYKATSHKSRLADNRLVPFEKIAAS

SEQ ID NO: 407 - protein, 322 aa, Solanum lycopersicum
  misc_feature (1)..(322): Public GI ID no. 126843214
  misc_feature (164)..(268): Pfam Name: 2OG-FeII_Oxy Pfam Description: 2OG-Fe(II) oxygenase superfamily
  misc_feature (1)..(322): Bit score of 570.1 for HMM based on sequences of Figure 5
  misc_feature (1)..(322): Functional Homolog Of SEQ ID NO. 287
MVILSKQTSFFNGVPLIDLSKPDSKNLIVNACEEFGFFKIINHDVPMEFISKLESEAIKFFSSPLSEKLKAGPADPFGYGNKQIGTNGDCGRVEHILVSTNSEFNYQKFASILGVNPENIRAAVNDYVSAVKKMSCDILEMLAEGLKIYPTNVFSKLLMDENSDSVFRLNHYPPCSEIERLNDNNNDLIGFGEHTDPQIISILRSNNTSGLQILLKDGHWISVPPDENSFFVNVGDSLQVMTNGRVKSVKHRVLANSVKSRLSMIYFGGPPLSEKIAPLASLMEGEDSSLYKEFTWFEYKKSAYKTRLADNRLILFEKIAAS

SEQ ID NO: 408 - protein, 326 aa, Triticum aestivum
  misc_feature (1)..(326): Public GI ID no. 327179125
  misc_feature (175)..(276): Pfam Name: 2OG-FeII_Oxy Pfam Description: 2OG-Fe(II) oxygenase superfamily
  misc_feature (1)..(326): Bit score of 542.4 for HMM based on sequences of Figure 5
  misc_feature (1)..(326): Functional Homolog Of SEQ ID NO. 287
MVVLASTPAVDHIPLLRSPDPGDYFSGMPVVDLSSPGAPRAIADACERFGFFKLVNHGVPADTMDRLESEAVRFFLLPQADKDRSGPAYPFGYGSKRIGLNGDMGWLEYLLLAVDSASLSGACAVPSCALFRAALNEYIAAVRKVAVRVMEAMAEGLGIAAVDALSGMVTAEGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVPMIYFGGPAMTQRIAPLPQLLGAGEQSLYKDFTWGEYKKAAYNSRLGDNRLAQFHR

SEQ ID NO: 409 - protein, 320 aa, Gossypium hirsutum
  misc_feature (1)..(320): Public GI ID no. 340796367
  misc_feature (170)..(270): Pfam Name: 2OG-FeII_Oxy Pfam Description: 2OG-Fe(II) oxygenase superfamily
  misc_feature (1)..(320): Bit score of 370.7 for HMM based on sequences of Figure 5
  misc_feature (1)..(320): Functional Homolog Of SEQ ID NO. 287
MVVAPPNPVRSEKPEPIELPVIDLSADRSEVSKLIVKACEQYGFFKAVHHGVSDDVIAAMEEEGLGFFTKPVCEKQRAGPAGPFGYGIKSIGFNGDSGEVEYLLLHTNPSSISQLSHTISDDSKKFSSAVSGYIEAVKRLACEILDLMAEGLGVHDPSLLSNKIRDVESDSMFRLNHYPPSSYRATTTTEIGFGEHTDPQMLTILRSNDVGGLQICVAGGTWVPVTPDPTAFCINVGDVLQAMTNGRFMSVRHRALTNGYKYRMSMAYFGAPPPHAWLSVPPELVTPHRPLLYRPFTWAEYKKVSYSLRLGDSRVQLLLK

SEQ ID NO: 410 - protein, 342 aa, Frankia
  misc_feature (1)..(342): Public GI ID no. 312195240
  misc_feature (1)..(342): Frankia sp. EuI1c
  misc_feature (194)..(298): Pfam Name: 2OG-FeII_Oxy Pfam Description: 2OG-Fe(II) oxygenase superfamily
  misc_feature (1)..(342): Bit score of 80.5 for HMM based on sequences of Figure 5
  misc_feature (1)..(342): Functional Homolog Of SEQ ID NO. 287
MTLAATTAGPAARNDAATRPRPDGGIPVIDLGPFLAGADPTPVVERIAQVCSSVSFLQVVGHGIAPEAFDAVYRANDALLALPDAEKAQLGSPDGHPWRGLSTMRSPEGSPLVHRFQVCNYEDAATALAAGVPSRYGDYFARNVWPEQVEGLRASVLRCLAEMKRVGDALMELFARALGLPPEHFAPMLTHPVSDLAVNTYPAQPARDSTEPSLTFREHTDSGMLTVLHQRGDYAGLQVQGLDDAWVTVPIDPAALVINIGDLMSRWTNDRWPSTRHRVVAAADTTSTRASIATFHLPNVDTVIAPLEPFVGPDGPHYEPVTPYVWEAMFLARYRAPDPDNR

SEQ ID NO: 411 - DNA, 1005 bp, Populus trichocarpa
  misc_feature (1)..(1005): Ceres Annot ID no. 1511928
  misc_feature (1)..(1005): Encodes the peptide sequence at SEQ ID NO. 412
atggtagtggcatctccaactaaacttcacagtgaagaacacctggccattgagcttcctacagtagacctctcaggagatagatcaatggtttccaatctcattgtcaaagcctgtgaggaatatggtttcttcaaggtgaaaaaccatggtgttcctcatgacatcattgcccaaatggagaaagaaagtttcaacttctttgccaaaccattcgatgaaaagcaaaaggttgagccggccaaaccctttggttatggctgcaaaaatattggcttcaatggtgatatgggagaggtggaatatctacttcttaatatcaaccctctctccatagctgaaaggtccaaaaccatctccaatgaccctgcaaaattcagctccgctgtgagtgcttacatagaagcagttagggagctggcatgtgagttattagatctgatggcggaggggctgcgggtcccggatagatcagtgtttagtaggctaatcagagatgttgacagtgactccctcatcaggttaaaccactacccccctatgcctctgctctgcaaggatgaggactcgtcaccttgtaaccaaaacaaggtagggttcggagagcattctgaccctcagatcttgaccatcttgagatccaacgatgtgggtggccttcagatttccttaaatgatggtgcgtgggtcccagtaacacctgatcccgctaccttctgggttaatgtgggtgacttgttacaggcaatgacaaatgggagatttgtaagtgtgaggcacaaagccctaaccaactcttccaagtctagaatgtcaatggcctattttgctggccctccacccaatgcgaggatcactgttccaccagaaatgattacccccaccaagccggcattatacaagccctttacctgggctgaattcaagaaagctgcttatgctatgcgacttggagatagacgccttggtctattcaggatggaaggagacgagcaagttgcttga

SEQ ID NO: 412 - protein, 334 aa, Populus trichocarpa
  misc_feature (1)..(334): Ceres Annot ID no. 1511928
  misc_feature (170)..(279): Pfam Name: 2OG-FeII_Oxy Pfam Description: 2OG-Fe(II) oxygenase superfamily
  misc_feature (1)..(334): Bit score of 401.1 for HMM based on sequences of Figure 5
  misc_feature (1)..(334): Functional Homolog Of SEQ ID NO. 287
MVVASPTKLHSEEHLAIELPTVDLSGDRSMVSNLIVKACEEYGFFKVKNHGVPHDIIAQMEKESFNFFAKPFDEKQKVEPAKPFGYGCKNIGFNGDMGEVEYLLLNINPLSIAERSKTISNDPAKFSSAVSAYIEAVRELACELLDLMAEGLRVPDRSVFSRLIRDVDSDSLIRLNHYPPMPLLCKDEDSSPCNQNKVGFGEHSDPQILTILRSNDVGGLQISLNDGAWVPVTPDPATFWVNVGDLLQAMTNGRFVSVRHKALTNSSKSRMSMAYFAGPPPNARITVPPEMITPTKPALYKPFTWAEFKKAAYAMRLGDRRLGLFRMEGDEQVA

SEQ ID NO: 413 - protein, 334 aa, Zea mays
  misc_feature (1)..(334): Public GI ID no. 226501026
  misc_feature (179)..(286): Pfam Name: 2OG-FeII_Oxy Pfam Description: 2OG-Fe(II) oxygenase superfamily
  misc_feature (1)..(334): Bit score of 505.4 for HMM based on sequences of Figure 5
  misc_feature (1)..(334): Functional Homolog Of SEQ ID NO. 287
MVVLAKPPALDQISLLRSPQPGDASSFPGVPAVNLSSPGAALAVVDACERFGFFKVVNHGVPAGVVDRLEAEAVRFFASPQAAKDACGCGPASPLGYGNRRIGRNGDMGWLEYLLLALDGNASVSKASPVPSSSLRDAVNQYVASVRGLATSVLEAVAEGLGVAPRDALSGMVADAASDQVFRINHYPACPLLQRLPDSCGVTGFGEHTDPQLVSVLRSNGTPGLQLALHGDDGRWVPVPPDRDAFFVIVGDSLQVLTNGRLKSVRHRVVANSLKPRVSMIYFAGPAPAQRIAPLPQLLGHGKQSLYRDFTWGDYKKAAYRSRLGDNRLDPFRI

SEQ ID NO: 414 - protein, 306 aa, Populus trichocarpa
  misc_feature (1)..(306): Public GI ID no. 224108798
  misc_feature (141)..(251): Pfam Name: 2OG-FeII_Oxy Pfam Description: 2OG-Fe(II) oxygenase superfamily
  misc_feature (1)..(306): Bit score of 371.4 for HMM based on sequences of Figure 5
  misc_feature (1)..(306): Functional Homolog Of SEQ ID NO. 287
MVSSLIVKACEEYGFFKVKNHGVPHDIIAKMENESFNFFAKTFDEKQKAGLDNSFGYGCKNIGFNGDTGEVEYLLCNTNPLSIAERSKTISNDPTEFRQQVYGYIEAVRELACELLDLMAEGLWVPDRSVFSRLIRDDDSDSIIRLNHYPAMPILCKDKDSSSPCNHNKVGFGEHSDPQILTILRSNDVGGLQISLNDGAWVPVTPDPTAFCVNVGDLLQAMTNGRFVSVRHKALTNSYKSRMSMAYFAAPPLNARIAVPPEMVTPIKPALYRPFSWAEFKNAAFALRLGDSRLGLFMLEVDDQVA

SEQ ID NO: 415 - protein, 345 aa, marine gamma
  misc_feature (1)..(345): Public GI ID no. 119475961
  misc_feature (1)..(345): marine gamma proteobacterium HTCC2143
  misc_feature (182)..(287): Pfam Name: 2OG-FeII_Oxy Pfam Description: 2OG-Fe(II) oxygenase superfamily
  misc_feature (1)..(345): Bit score of 97.8 for HMM based on sequences of Figure 5
  misc_feature (1)..(345): Functional Homolog Of SEQ ID NO. 287
MSEPSTAPFSEWREAVVFDAEVLRGNGEVRDRELQRLLQAVERWGFFELQGHGIETQHMKALFAAQRAFFALPDAQKLSLRRTETNARGYNPRELTKNQIDAKEILDFGHKPDPTADDDAPVNRVVDGWNQMPEDAGICTPIWDWFGLCEPLAIEVYGWLLEAMGASDDLASLTRGHTSFLRLNAYSDAHRLTQSQTKGPDSPVPLGIHRHTDAGLLTLLVENGHHALQVLHDRQWHMIEPAPNAFIVNTGDMLQVLSNDRFVAPEHRVLGSVGSQYRLSAAYFFNPPYAQVIEALPCKPVDFSGHSNDDKPRYRGFTWEEFRRRRGAGDYQDLGEEVQISHYRI

SEQ ID NO: 416 - DNA, 1247 bp, Glycine max
  misc_feature (1)..(1247): Ceres Clone ID no. 539037
  misc_feature (1)..(1247): Encodes the peptide sequence at SEQ ID NO. 417
acaagcatcctctgttcagagcctcattaagtttttctctctttcacttatttattgactctccataagcccttcaaacctctctctattcctctctactagtcaccttctcccttccattcactccacttcttaacacccccaaacagaacaacggcagagcaagcagccagaaaaatggtgttgctgtccaaagcaacaacagaacaatactcctacatcaagaactacatgccaactgcattctcctcaacaattcccatagtggacctctccaaacccgatgcaaagaccctcatagtgaaggcttgtgaggagtttggattcttcaaagtcatcaaccatggtgttcccattgaagctatatcccaattggaatccgaagccttcaagttcttctctatgccactcaatgagaaggaaaaagcagggcctcccaaaccatttgggtgtctattaaacagttacatgtcttctgtgagaaaaatggcatgcgagattcttgagttgatggcagaaggattgaagattcagcaaaagaatgtgtttagcaagcttctgatggataaacagagtgactctgttttcagggtgaatcactaccctgcttgtcctgaacttgccgtgaatggtcagaacttgattgggttcggagaacatacagacccacaaatcatttctttacttaggtccaacaacacttcaggccttcagatttttcttagagatggaaactggatttcagtcccacctgatcacaaatctttcttcataaatgttggtgattctcttcaggttatgaccaatggaagatttcggagtgtgagacatagagttttggcaaatggatttaagtctaggctctcaatgatttactttggaggtccacctttgagtgaaaaaatagcgccattaccttctctcatgaaaggaaaagaaagcttatataaagaatttacgtggtttgagtacaagaattcaacctatggttcaagattggctgataataggcttggacattttgagagaattgttgcttgataatatgtagagaattatgggggcacttgtcaatacaaaatgggggttacaatagtctatatactataaatgttttttctttttcttttttctactttaaggttatttatcaattagaatgcctcacagatataggacaacgcatacaccccttttgcttcaacactagtgaatgcatctgatgtagttaacaatggagatttgat

SEQ ID NO: 417 - protein, 287 aa, Glycine max
  misc_feature (1)..(287): Ceres Clone ID no. 539037
  misc_feature (134)..(235): Pfam Name: 2OG-FeII_Oxy Pfam Description: 2OG-Fe(II) oxygenase superfamily
  misc_feature (1)..(287): Bit score of 373.5 for HMM based on sequences of Figure 5
  misc_feature (1)..(287): Functional Homolog Of SEQ ID NO. 287
MVLLSKATTEQYSYIKNYMPTAFSSTIPIVDLSKPDAKTLIVKACEEFGFFKVINHGVPIEAISQLESEAFKFFSMPLNEKEKAGPPKPFGCLLNSYMSSVRKMACEILELMAEGLKIQQKNVFSKLLMDKQSDSVFRVNHYPACPELAVNGQNLIGFGEHTDPQIISLLRSNNTSGLQIFLRDGNWISVPPDHKSFFINVGDSLQVMTNGRFRSVRHRVLANGFKSRLSMIYFGGPPLSEKIAPLPSLMKGKESLYKEFTWFEYKNSTYGSRLADNRLGHFERIVA

SEQ ID NO: 418 - protein, 334 aa, Nerium oleander
  misc_feature (1)..(334): Public GI ID no. 50293061
  misc_feature (180)..(278): Pfam Name: 2OG-FeII_Oxy Pfam Description: 2OG-Fe(II) oxygenase superfamily
  misc_feature (1)..(334): Bit score of 578.8 for HMM based on sequences of Figure 5
  misc_feature (1)..(334): Functional Homolog Of SEQ ID NO. 287
MVVLSQPALENLSHISTCKFPSTNFYEGIPVIDLFKPEANTEIVKACQEFGFFKVINHGVPLEFITKLEGEAVKFFNLPQPEKEKVRPAKPFGYGNKRIGQNGDVGWIEYLLLNTNPELVYEKAVTIPGDSELFWSCVNDYVSAVRSMACDVLDMIADGLKIGPRNVLSRLLRDEKSDAVFRLNHYPPCPELQALSGRNLIGFGEHTDPQIISVVRSNNTSGLQISLKDGTWVSVPPDQYSFFINVGDSLQVMTNGRFRSVKHRVFADGLKSRVSMIYLGGPPLDEKIAPLSSLMEEGEESLYKEFTWCEYKKSAYKTRLGDNRLKFFEKSVGQ

SEQ ID NO: 419 - protein, 347 aa, Daucus carota
  misc_feature (1)..(347): Public GI ID no. 50428337
  misc_feature (165)..(291): Pfam Name: 2OG-FeII_Oxy Pfam Description: 2OG-Fe(II) oxygenase superfamily
  misc_feature (1)..(347): Bit score of 349.9 for HMM based on sequences of Figure 5
  misc_feature (1)..(347): Functional Homolog Of SEQ ID NO. 287
  misc_feature (248)..(248): Xaa is any aa, unknown, or other
MVLASLAPSSAEKIRDMELPIINFSDKRSDVSKMIVKASEEFGFFKVINHGVSEDIIRNLEVECFEFFGKTAPEKQKAGPANPYGYGSKNIGFNGDSGEVEYLIMDTKNPLSIASAEPTRFSCAVRVYVEAVRRVGCEVLEMMAEGLGVPDTSVFSSLITHVDNDSLLRLNHYPPLLPPHHFHTNNLTHYDTSSAPSFPQQLNAGKNNRIGFGEHTDPQILTILRSNGVAGLQISLGDGVWVPISPDXTALCVNVGDVLQAMTNGRFVSVIHRAMANSDKARMSMAYFCAPPFHAKIACPKELVTLERPNLYKPFTWAEYKKVVYSLRLGDSRLKLFKLQSDDETRD

SEQ ID NO: 420 - protein, 333 aa, Vitis vinifera
  misc_feature (1)..(333): Public GI ID no. 225437645
  misc_feature (170)..(272): Pfam Name: 2OG-FeII_Oxy Pfam Description: 2OG-Fe(II) oxygenase superfamily
  misc_feature (1)..(333): Bit score of 408.6 for HMM based on sequences of Figure 5
  misc_feature (1)..(333): Functional Homolog Of SEQ ID NO. 287
MVVPSPSPIRSKKTKAVGIPVIDLSLNRSAIAELIVNACEDYGFFKVVNHGVPKEIIGRLEEEGLSFFAKPSSEKQKAGPASPFGYGCKNIGFNGDRGELEYLLLHTNPVSISERSKAISNDPTEFSCAVTDYIQGVRELCCEILDLIGEGLWLQDKMVFSRMIRDVHSDSVIRVNHYPAVKDVKEWDPCDPIGFGEHSDPQILTILRSNDVPGLQIRLRDGLWVPVPPDPTEFCVFVGDALEAMTNGRLMSVRHRALTSSVKARLSMMYFGAPPLNAWISPLPDMVSPQKPSLYRPFSWVEYKKAAYSLRLGDRRLDLFKINTSSTGDKVEL

SEQ ID NO: 421 - protein, 327 aa, Oryza sativa
  misc_feature (1)..(327): Public GI ID no. 115440025
  misc_feature (1)..(327): Oryza sativa Japonica Group
  misc_feature (175)..(276): Pfam Name: 2OG-FeII_Oxy Pfam Description: 2OG-Fe(II) oxygenase superfamily
  misc_feature (1)..(327): Bit score of 546.8 for HMM based on sequences of Figure 5
  misc_feature (1)..(327): Functional Homolog Of SEQ ID NO. 287
MVVLAGPPAVDHIPLLRSPDPGDVFSGVPVVDLGSPGAARAVVDACERYGFFKVVNHGVATDTMDKAESEAVRFFSQTQPDKDRSGPAYPFGYGSKRIGFNGDMGWLEYLLLALDDASLADACTVPSCAVFRAALNEYISGVRKVAVRVMEAMSEGLGIAQADALSALVTAEGSDQVFRVNHYPPCRALQGLGCSVTGFGEHTDPQLVSVLRSNGTSGLQIALRDGQWVSVPSDRDSFFVNVGDSLQVLTNGRFKSVKHRVVANSLKSRVSFIYFGGPPLAQRIAPLPQLLGEGEQSLYKEFTWDEYKKAAYKSRLGDNRLAQFEKK

SEQ ID NO: 422 - protein, 349 aa, Hordeum vulgare
  misc_feature (1)..(349): Public GI ID no. 326522773
  misc_feature (1)..(349): Hordeum vulgare subsp. vulgare
  misc_feature (195)..(297): Pfam Name: 2OG-FeII_Oxy Pfam Description: 2OG-Fe(II) oxygenase superfamily
  misc_feature (1)..(349): Bit score of 435.8 for HMM based on sequences of Figure 5
  misc_feature (1)..(349): Functional Homolog Of SEQ ID NO. 287
MVVLAKGELEQIALPAVHKTAPPLADLPEVDLSVARSGSEGRAAAARAVAAACEEHGFFKVTGHGVPAELLARVENAAAAFFALSQRDKEAAMSAATPGSPFGYASKRIGNNGDLGWVEYLLLGVTAAGAEAGAPLSVPEEVVPSASLCSFRDLLNEYTVAVRRMTCQLLELMAEGLGMEDRDAFTRLVLHKESDSMLRVNHYPPRPELKQHHGGRVTGFGEHTDPQIISVLRSNATSGLEIALRDGDWVSVPPDQTSFFVNVGDALQVLTNGRFRSVRHRVMVNNIQPRVSVIFFGGPPPRETLAPLPQLVGEGGRSRYKEFTWCEYKASAYGTKLAANRLCHFETTN

SEQ ID NO: 423 - protein, 345 aa, Oryza sativa
  misc_feature (1)..(345): Public GI ID no. 218187724
  misc_feature (1)..(345): Oryza sativa Indica Group
  misc_feature (190)..(295): Pfam Name: 2OG-FeII_Oxy Pfam Description: 2OG-Fe(II) oxygenase superfamily
  misc_feature (1)..(345): Bit score of 382.5 for HMM based on sequences of Figure 5
  misc_feature (1)..(345): Functional Homolog Of SEQ ID NO. 287
MFQQTLASRPWWCLPRASSSRYPLPAAHPPPADVRAIDLSATGPARARGARAGAACEEQGFFRVTGHGVPPGLVRAAEAAAARFFALPQPDKEAAAGAPLGYASKRIGSAGDLGWIEYLLLCLAPAAAAAAALPCAATSPTPPCPLRELLSEYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDVGRSRYREFTWKEYKGSGCKGRLADDRLCRFEN

SEQ ID NO: 424 - protein, 339 aa, Gossypium hirsutum
  misc_feature (1)..(339): Public GI ID no. 340796363
  misc_feature (171)..(278): Pfam Name: 2OG-FeII_Oxy Pfam Description: 2OG-Fe(II) oxygenase superfamily
  misc_feature (1)..(339): Bit score of 393.9 for HMM based on sequences of Figure 5
  misc_feature (1)..(339): Functional Homolog Of SEQ ID NO. 287
MVGVPSPACLRAKKTRAVGIPVVDLSLDRSIVSQLIVKACEEYGIFKVMNHGVHWEIISRLEGEGVQFFGKPAGVKQRAGPANPFGYGVKNIGLNGDKGELEYLLLHTNPFSTAERSESISNQPQNFTCTANDYIEAVKELASEVLDLVGEGLSIPDKHVFSRQIKDFQSDSILRFNHYPPAKNQDPSSKACKENQIGFGEHSDPQILTILRSNDVAGLEIRLQDDGFWIPVPPDPTQFYVIIGDALRVLTNGRFVSVRHRALANSSRNSRMSMMYFGAPPLNAIISPLPQFVSPQNPRLYRPFTWGEYKKAAYTSRLGDCRLDLFKLHITDDTLALFS

SEQ ID NO: 425 - protein, 340 aa, Vigna angularis
  misc_feature (1)..(340): Public GI ID no. 67077816
  misc_feature (172)..(275): Pfam Name: 2OG-FeII_Oxy Pfam Description: 2OG-Fe(II) oxygenase superfamily
  misc_feature (1)..(340): Bit score of 383.3 for HMM based on sequences of Figure 5
  misc_feature (1)..(340): Functional Homolog Of SEQ ID NO. 287
MVVPSPTSSKIASNKTKAMGIPTIDLSMERSQLSQTVVKACEEYGFFRVVNHNVPKEVIARLEEEGAEFFSKPSHEKRRAGPASPFGYGFTNIGPNGDMGDLEYLLLHANPLSIAQISKTIANDSTKFSTVVKEYVEVVKEVTCEILDLVVEGLGVADKSGLSRLIRDFDSDSVLRMNHYPPLKVKWKGNKNSIGFGAHSDPQMLTIMRSNDVGGLQIYTREGLWLPVPPDPTNFFVMVGDVLQVMTNGKFMSVRHRALTNTSEARMSMIYFAAPPLDWWIAPLPEMVSPPENESVYKAFTRAQYKEATYSLRLGDSRLDLFRAQIDTHLLSSSQSQFQR

SEQ ID NO: 426 - DNA, 1230 bp, Arabidopsis thaliana
  misc_feature (1)..(1230): Ceres Clone ID no. 156482
  misc_feature (1)..(1230): Encodes the peptide sequence at SEQ ID NO. 427
atgtctcagccttcaaagctatcaaaatcaaaaaaattctatcaaacaaggaaatatatcaatggcggtattgtctaaaccggtagcagtaccaaaatccgggttctctctaatcccggttatagatatgtctgacccagaatccaaacatgccctcgtgaaagcatgcgaagacttcggcttcttcaaggtgatcaaccatggcgtttccgcagagctagtctctgttttagaacacgagaccgtcgatttcttctcgttgcccaagtcagagaaaacccaagtcgcaggttatcccttaggatacgggaacagtaagattggtcggaatggtgacgtgggttgggttgagtacttgttgatgaacgctaatcttgattccggttcgggtccactatttccaagtcttctcaaaagcccgggaactttcagaaacgcattggaagagtacacaacatcagtgagaaaaatgacatgcgatgttttggagaagatcacagatgggctagggatcaaaccgaggaacacacttagcaagcttgtgtctgaccaaaacacggactcgatattgagacttaatcactatccaccatgtcctcttagcaataagaaaaccaatggtggtaagaatgtgattggttttggtgaacacacagatcctcaaatcatctctgtcttaagatctaacaacacttctggtctccaaattaatctaaatgatggctcatggatctctgtccctcccgatcacacttccttcttcttcaacgttggtgactctctccaggtgatgacaaatgggaggttcaagagcgtgaggcatagggttttagctaactgtaagaaatctagggtttctatgatttacttcgctggaccttcattgactcagagaatcgctccgttgacatgtttgatagacaatgaggacgagaggttgtacgaggagtttacttggtctgaatacaaaaactctacctacaactctagattgtctgataataggcttcaacaattcgaaaggaagactataaaaaatctcctaaattgattgatatatctatttaatctataagtgtgtgctacatacagacaatgcatctgtatattttgaagttaatgttatttgttaatccaataactgtaaaaacatgcaagagtgtgtttgtttgtttcgtaatatcaacatcgctcccatcttttatggataatatcaagttgtttaaacac

SEQ ID NO: 427 - protein, 329 aa, Arabidopsis thaliana
  misc_feature (1)..(329): Ceres Clone ID no. 156482
  misc_feature (167)..(273): Pfam Name: 2OG-FeII_Oxy Pfam Description: 2OG-Fe(II) oxygenase superfamily
  misc_feature (1)..(329): Bit score of 530.4 for HMM based on sequences of Figure 5
  misc_feature (1)..(329): Functional Homolog Of SEQ ID NO. 287
MAVLSKPVAVPKSGFSLIPVIDMSDPESKHALVKACEDFGFFKVINHGVSAELVSVLEHETVDFFSLPKSEKTQVAGYPLGYGNSKIGRNGDVGWVEYLLMNANLDSGSGPLFPSLLKSPGTFRNALEEYTTSVRKMTCDVLEKITDGLGIKPRNTLSKLVSDQNTDSILRLNHYPPCPLSNKKTNGGKNVIGFGEHTDPQIISVLRSNNTSGLQINLNDGSWISVPPDHTSFFFNVGDSLQVMTNGRFKSVRHRVLANCKKSRVSMIYFAGPSLTQRIAPLTCLIDNEDERLYEEFTWSEYKNSTYNSRLSDNRLQQFERKTIKNLLN

SEQ ID NO: 428 - protein, 325 aa, Gossypium hirsutum
  misc_feature (1)..(325): Public GI ID no. 340796365
  misc_feature (170)..(275): Pfam Name: 2OG-FeII_Oxy Pfam Description: 2OG-Fe(II) oxygenase superfamily
  misc_feature (1)..(325): Bit score of 366.1 for HMM based on sequences of Figure 5
  misc_feature (1)..(325): Functional Homolog Of SEQ ID NO. 287
MVVAPPNPVRSEKPEPIELPVIDLSADRSEVSKLIVKACEQYGFFKAVHHGVSDDVIAAMEEEGLGFFTKPVCEKQRAGPAGPFGYGIKSIGFNGDSGEVEYLLLHTNPSSISQLSHTISDDPKKFSSAVSGYIEAVKRLACKILDLMAEGLGVHDPSLLSNMIRDVDSDSMFRLNRYPPSSFHTPPPPHRATTEIGFGEHTDPQMLTILRSNDVGGLQICVAGGTWVPVTPDPTAFCINVGDVLQAMTNGRFMSVRHRALTNGFKYRMSMAYFGAPPPRAWLSVPPELVTPHRPLLYRPFNWAEYKKAFYFFRLGDSRLQLFFK

SEQ ID NO: 429 - protein, 340 aa, Sorghum bicolor
  misc_feature (1)..(340): Public GI ID no. 242086999
  misc_feature (149)..(278): Pfam Name: 2OG-FeII_Oxy Pfam Description: 2OG-Fe(II) oxygenase superfamily
  misc_feature (1)..(340): Bit score of 286.0 for HMM based on sequences of Figure 5
  misc_feature (1)..(340): Functional Homolog Of SEQ ID NO. 287
MVVPSTTPVVVRQETPPPPLPLPPSHDGIIGIPTVDMSAPGGRGALSRQVARAMRAGPPSPLGYGCRTIGFNGDAGELEYLLLHANPAAVAHRARSIDTDDPSRFSNVVNEYVGAMRQLACEILDLLGEGLGLKDPRSFSKLITDTDSDSLLRINHYPPACTIQKLDHDNQCKMKSSFRIKTGNGVNQSAGARIGFGEHSDPQILSLLRSNDVDGLQVLLNCDGREVWVQVPSDPSAFFVNVGDLLQALTNGKVISVRHRVIANSCRARLSTIYFAAPPLHARILALPETITANSPRQYRPFTWAEYKKTMYSLRLSHSRLNLFHIDHDDHSNVGKGEQE

SEQ ID NO: 430 - protein, 338 aa, Zea mays
  misc_feature (1)..(338): Public GI ID no. 226501846
  misc_feature (180)..(283): Pfam Name: 2OG-FeII_Oxy Pfam Description: 2OG-Fe(II) oxygenase superfamily
  misc_feature (1)..(338): Bit score of 442.3 for HMM based on sequences of Figure 5
  misc_feature (1)..(338): Functional Homolog Of SEQ ID NO. 287
MVVLTKGELEQIALPAVQRASPPPPAAVPEVDLAAGDAAAARAVAKACEDHGFFKVTGHGVPQHLLARLEAAAAAFFALPQREKDRAAGCPFGYASKRIGANGDLGWVEYLLLAVTAAGAAAAPVSACEGAEPPCFRAVLDEYVAAVRRMTCTVLQLMAQGLGLDDRDVFSRLVLDRDSDSMLRVNHYPPRPQPAAAAETRRLTGFGEHTDPQIISVLRSNDASGLEITLRDGTWVSVPSDTESFFVNVGDALQVLTNGRFRSVRHRVMVSSARPRVSVIFFGGPPPRERLAPLPGLVDREGGRRRYREFTWREYKNSAYRTKLADNRLCSFETMATS

SEQ ID NO: 431 - DNA, 1047 bp, Populus trichocarpa
  misc_feature (1)..(1047): Ceres Annot ID no. 1444853
  misc_feature (1)..(1047): Encodes the peptide sequence at SEQ ID NO. 432
atggtagttccttctccaactccagcacgaaccagaaaaacgaaggcctttggaattcctactgttgatctctctcttgataggtcaaacgtatcgaaactgatcgtaagggcatgtgaagaatatggattcttcaaagttacgaatcatggggtcagtaaggaggtcgtaaccagaatggaggaggaagctgctcattttttctcaaaaccagccacggaaaagcaccgagctggacctgctagtccttttggctatggttgcaaaaatattggctacaatggagacatgggcgagcttgaatatcttctcctccacgccaatcctctctccgtctttgaaagatccaaaaccatctcaaatgacccttcagaattcaggatgatcaattgctgggtagggaagaagcactggcattgcgatttatacagctgcgtggtgaatgattacatacaagcggttaagcaactggcgtgtgagattcttgatctaacggctgagggcttgtgggtcccggataaacgtgcattcagcaggttcatcagagatgtccacagcgattctgttcttagacttaatcactaccctgcattcgaagagatcatggactgggacccatcacctaaaacaattggttttggcgagcactccgaccctcaaatcttgaccatcttgcgatccaacgacgttgggggcctccaaatttatttgcgtgatggcttgtgggtccctgttcctcctgaccccaccggattctatgtgatcgtgggggatgccttccaggttttaacgaatgggaggtttgaaagcgttagacacagagtgttggcgagctcggggaagccaagaatgtcaatgatgtactttggggcgccaccgcttaacgcatggatctctccgcctccacagctggtcttgccacaaaatccaagcctctacaaacccttcacttggagtgaattcaagaaagctgcctattctctgcgattgagagatacgcgtcttgacctcttcaagattcatgccacagaaaaatttgcttcttga

SEQ ID NO: 432 - protein, 348 aa, Populus trichocarpa
  misc_feature (1)..(348): Ceres Annot ID no. 1444853
  misc_feature (187)..(290): Pfam Name: 2OG-FeII_Oxy Pfam Description: 2OG-Fe(II) oxygenase superfamily
  misc_feature (1)..(348): Bit score of 392.9 for HMM based on sequences of Figure 5
  misc_feature (1)..(348): Functional Homolog Of SEQ ID NO. 287
MVVPSPTPARTRKTKAFGIPTVDLSLDRSNVSKLIVRACEEYGFFKVTNHGVSKEVVTRMEEEAAHFFSKPATEKHRAGPASPFGYGCKNIGYNGDMGELEYLLLHANPLSVFERSKTISNDPSEFRMINCWVGKKHWHCDLYSCVVNDYIQAVKQLACEILDLTAEGLWVPDKRAFSRFIRDVHSDSVLRLNHYPAFEEIMDWDPSPKTIGFGEHSDPQILTILRSNDVGGLQIYLRDGLWVPVPPDPTGFYVIVGDAFQVLTNGRFESVRHRVLASSGKPRMSMMYFGAPPLNAWISPPPQLVLPQNPSLYKPFTWSEFKKAAYSLRLRDTRLDLFKIHATEKFAS

SEQ ID NO: 433 - protein, 354 aa, Nicotiana sylvestris
  misc_feature (1)..(354): Public GI ID no. 29825611
  misc_feature (209)..(306): Pfam Name: 2OG-FeII_Oxy Pfam Description: 2OG-Fe(II) oxygenase superfamily
  misc_feature (1)..(354): Bit score of 139.0 for HMM based on sequences of Figure 5
  misc_feature (1)..(354): Functional Homolog Of SEQ ID NO. 287
MVKSTNHSQQPNQKLSMRESPDPPFEETYKKLFDDIRIGKASNINYHNLFVVEECELPLIDLELLNGREFEREECKRKIAKASQEWGFFQVVNHGISHDILEKMRMEQIKLFKKPFNEKMNEKNHKFSKGSYRWGTPSATCLQQLSWSEAFHVPLTDISNSSGVSSLSTTMEQYATTLSELAHKLARILSEKMGYKSKYFRETCLVNTCYLRMNRYPACPLSPQVFGLMPHTDSDFLTILHQDEIGGLQLVRDGKWISVKPNPQALIINIGDLFQAWSNGVYKSVEHRVVTNKAKERFSTAFFLCPSYDTEIRSCFEPPVYRRFTFREFRQQVQEDVKNFGYKVGLPRFLVSSH

SEQ ID NO: 434 - protein, 306 aa, Oryza sativa
  misc_feature (1)..(306): Public GI ID no. 125572075
  misc_feature (1)..(306): Oryza sativa Japonica Group
  misc_feature (176)..(277): Pfam Name: 2OG-FeII_Oxy Pfam Description: 2OG-Fe(II) oxygenase superfamily
  misc_feature (1)..(306): Bit score of 404.6 for HMM based on sequences of Figure 5
  misc_feature (1)..(306): Functional Homolog Of SEQ ID NO. 287
MVVLAGPPAVDHIPLLRSPDPGDVFSGVPVVDLGSPGAARAVVDACERYGFFKVVNHGVATDTMDKAESEAVRFFSQTQPDKDRSGPAYPVRVRQQADRVQWRHGVARSTSSSPSTTRRSPDACTVPSCAVFRAALNEYISGVRKVAVRVMEAMSEGLGIAQADALSALVTAEGSDQVFRVNHYPPCRALQGLGCSVTGFGEHTDPQLVSVLRSNGTSGLQIALRDGQWVSVPSDRDSFFVNVGDSLQVLTNGRFKSVKHRVVANSLKSRVSFIYFGGPPLAQRIAPFATAAGGGRAEPVQGVHMG

SEQ ID NO: 435 - protein, 331 aa, Arabidopsis lyrata
  misc_feature (1)..(331): Public GI ID no. 297842621
  misc_feature (1)..(331): Arabidopsis lyrata subsp. lyrata
  misc_feature (167)..(273): Pfam Name: 2OG-FeII_Oxy Pfam Description: 2OG-Fe(II) oxygenase superfamily
  misc_feature (1)..(331): Bit score of 525.9 for HMM based on sequences of Figure 5
  misc_feature (1)..(331): Functional Homolog Of SEQ ID NO. 287
MAVLSKPVAVPKSGFSPIPVIDMSDPESKHALVKACEDFGFFKVINHGVSAELVSVLEHETVEFFSLPKSEKTQVAGYPFGYGNSKIGRNGDVGWVEYLLMNASLDPGSGPLFQSLLKSPGTFRNALEEYTTSVRKMTCDVLEMITDGLGIKPMNTISKLVSDQNTDSILRLNHYPPCPLIDKKTNGGENVIGFGEHTDPQIISVLRSNNTSGLQINLTDGSWVAVPPDHSSFFFNVGDSLQVMTNGRFRSVRHRVLANSDKSRVSMIYFAGPSLTQRIAPLTCLMDNEDEMLYEEFTWSEYRNSAYNSRLSDNRLQQFERKTTNNNTLFD

SEQ ID NO: 436 - protein, 332 aa, Torenia fournieri
  misc_feature (1)..(332): Public GI ID no. 320462782
  misc_feature (1)..(332): Public GI ID no. 320462782
  misc_feature (181)..(278): Pfam Name: 2OG-FeII_Oxy Pfam Description: 2OG-Fe(II) oxygenase superfamily
  misc_feature (1)..(332): Bit score of 500.9 for HMM based on sequences of Figure 5
  misc_feature (1)..(332): Functional Homolog Of SEQ ID NO. 287
MVAMSQQITDNIAQERPNKPTTCEIFTLQIPVIDLADHSDARNLIVEACKEFGFFKVINHGVPTELMSMLEEELFNFFKLPQQEKDKCGPANPFGYGNKRIGLNGDVGWIEYLLFCTNPEIISQNPEAVVPKISESLSVLVNEYISEVRNMACNVLEMMVDEMKIEPRDVLSKLIRDDNSDSCFRFNHYPPACSDHQMGIGEHTDPQIISVGRSNNTSGLQISLRSDGSWVSVPPDDTSFFFNVGDSLQVMSNGRFKSVKHRVIADGASSRVSMIFFGGPPLSEKIKPLQSIMEEGEESLYKEFTWFEYKNSAYKTRLGDDRLGLFEKSASQ

SEQ ID NO: 437 - protein, 340 aa, Gossypium hirsutum
  misc_feature (1)..(340): Public GI ID no. 340796361
  misc_feature (180)..(282): Pfam Name: 2OG-FeII_Oxy Pfam Description: 2OG-Fe(II) oxygenase superfamily
  misc_feature (1)..(340): Bit score of 578.9 for HMM based on sequences of Figure 5
  misc_feature (1)..(340): Functional Homolog Of SEQ ID NO. 287
MVVHSQSAALDHCSLIKTCKPTTSVFKGIPVVDLRDPEAKNLIVKACEEYGFFKLVNHGVPMEFFTRLEAEALKFFNLPQSDKDKAGLPDPFGYGFKKIGSNGDVGWVEYLLLNTNPQITSLKSLTVFRETPEIFRSSAVNDYIQAVKRMTFEVVELLADGLKIEPRDALSRLLRDEKSDSCFRLNHYPPCPELQALGGRNLIGFGEHTDPQIISVLRSNNTSGLQICLRDKTWVSVPPDQTSFFINVGDALQVMTNGRLRSVRHRVLAESMRSRVSMIYFGGPPLSEKIAPLASLMAKGEESLYEEFTWWEYKTSAYKSRLGDYRLGLFEKKTGGAAGQ

SEQ ID NO: 438 - protein, 333 aa, Vitis vinifera
  misc_feature (1)..(333): Public GI ID no. 225443855
  misc_feature (177)..(279): Pfam Name: 2OG-FeII_Oxy Pfam Description: 2OG-Fe(II) oxygenase superfamily
  misc_feature (1)..(333): Bit score of 571.4 for HMM based on sequences of Figure 5
  misc_feature (1)..(333): Functional Homolog Of SEQ ID NO. 287
MVVLSQNGRQQLPLIKACKPNYGFTGIPVIDMTSPHAKAHMVEACEEFGFFKLVNHGVPMEFMSRLEDEGIKFFSLPQSEKDLAGPPQPFGYGNRRIGPNGDVGWIEYLLLSTNPDSISQICSSISPENPEIFGSAVVDYVSSVKNMTYEVLEMIAEGLNIEPRNVLSRLLKDEESDSCFRVNHYPPCPELEALRGRVLVGFGEHTDPQIISVLRSNNTNGLEICLKDGTWVSVPPDQDSFFINVGDSLQVMTNGKFKSVKHRVVTESRKARVSMIYFGGPPLTEIIAPLPSLVKEGEETLYKEFTWADYKKSVYKSRLADNRLGLFEKKEQP

SEQ ID NO: 439 - DNA, 1697 bp, Panicum virgatum
  misc_feature (1)..(1697): Ceres Clone ID no. 1860822
  misc_feature (1)..(1697): Encodes the peptide sequence at SEQ ID NO. 440
atccccatgtgagcgagaaacaaagcctctcaagctcgagttcgaccaaaccgtccccctgcttccaatccattccatccccctctgcttcttggagacacacgcgcgcgcacacataaacgtcggaaattccgcggcgaccaccctgtccgtgcgagcctgtactactgcaaccatggtggtccttgccaagggcgagctggagcagatcgcgctcccggcggtgcagcgcgcggcgccgccgctggccgccgtgccggaggtcgacctggccctggcggcagcggatgccgggggcggcgcgcgcggtggccagggcgtgcgaggagcacggcttcttcaaggtgacgggccacggcgtgcccgcgccgctcctggcgcgcgtggaggccgccgccgccgccttcttcgcgctcccgcagcaggagaaggagaaggccgccgcggcgccggggggcggcagcccgttcgggtacgccagcaagcggataggcggcaacggcgacctcggctgggtcgagtacctcctgctcggcgtcggcgccgcggcgttgcccggcgcgccattgtccgacgcgcccgcgggggcgtcgccctgctctttccgggagcttcttgacgagtacgtggcggcggtgcggcggatgacgtgcgcggtgctggagctgatggcggagggcctggggctggaggacaccggcgcgctcgcccggctggtgctggccggcgacagcgactccatgctgcgggtgaaccactacccgccggcgccgcgcccggagcccggccgccgcctgacggggttcggcgagcacaccgacccgcacatcatctcggtgctccgctccaacgccaccgccggcctcgagatctcgctgcgggacggcacctgggtcgccgtgcccgccgacgcggactccttcttcgttaacgtcggcgacgcactccaggtgctgacgaacgggaggttccggacagggttaacaatttcggctaaatttcatcgaaatttcggaaaattttccgttttcgctagttaccgggattcgaaatttcggtatttttcgaaaaatttcgttttcaaattcaaaattcaacaaatttcgaccgaaattcaccgaaattcgccgaaatttaccgaaatttcggaacgaaatttcgtttccggtaaacaccgggatttgaccggaaaacgaaatggttaaccctggttccggagcgtgcggcaccgggtgatggtgagcagcgcgcggccgcgggtgtcggtcgtcttcttcggcggcccgccgccgcgggagcgcctggcgccgctgccggggctggtggaccgggacgggggccgccgccgctacagggacttcacctggagggagtacaagacctccgcctaccggaccaggctcgccgacaaccgcctcgcccacttcgagttcgagttcgacaccacgccgcccgccgccgccaccagctagcatcattgtgtagtagcgtacgtacaaatgttttgtttttgtgtgtggttgggtgtgcggggacgatcgagagcagccaggggccggtggtgcaccgtgcaccgccggccaagagtgagctcagggcggaggcaaccgtgtaagggcagagtggcgagacgaagatggtagaaatgtgctacactgtaaataagtagccagcaaggcaccgagatctcgaatgcc

SEQ ID NO: 440 - protein, 305 aa, Panicum virgatum
  misc_feature (1)..(305): Ceres Clone ID no. 1860822
  misc_feature (150)..(229): Pfam Name: 2OG-FeII_Oxy Pfam Description: 2OG-Fe(II) oxygenase superfamily
  misc_feature (1)..(305): Bit score of 296.5 for HMM based on sequences of Figure 5
  misc_feature (1)..(305): Functional Homolog Of SEQ ID NO. 287
MPGAARAVARACEEHGFFKVTGHGVPAPLLARVEAAAAAFFALPQQEKEKAAAAPGGGSPFGYASKRIGGNGDLGWVEYLLLGVGAAALPGAPLSDAPAGASPCSFRELLDEYVAAVRRMTCAVLELMAEGLGLEDTGALARLVLAGDSDSMLRVNHYPPAPRPEPGRRLTGFGEHTDPHIISVLRSNATAGLEISLRDGTWVAVPADADSFFVNVGDALQVLTNGRFRTGLTISAKFHRNFGKFSVFASYRDSKFRYFSKNFVFKFKIQQISTEIHRNSPKFTEISERNFVSGKHRDLTGKRNG

SEQ ID NO: 441 - protein, 344 aa, Solanum lycopersicum
  misc_feature (1)..(344): Public GI ID no. 126843218
  misc_feature (174)..(295): Pfam Name: 2OG-FeII_Oxy Pfam Description: 2OG-Fe(II) oxygenase superfamily
  misc_feature (1)..(344): Bit score of 380.1 for HMM based on sequences of Figure 5
  misc_feature (1)..(344): Functional Homolog Of SEQ ID NO. 287
MVVATPSPLIRRGNKKKTAAFGVPTIDLSDDKSIASEMIVKACEDYGFFKVINHGVSKKVIARMEREAADFFSRPVSEKGRAGPAAPFGYGSKNIGFNGDKGDLEYILLEANTLSLSQRAKNFSNDPSTFSSVTNDYVSAVRKLSCDILELVAEGLWIEDNSIFSKLISDSHNDSCFRVNHYPPFITPNNDDNQDELNNNHWGLSPNPSKSRVGFGEHTDPQMLTILRSNDVSGLQIYTHDGFWIPVPPDPNEFFVFVGDSFQALTNGRFTSVRHRVVSINSWKSRMSMMYFAAPALGAWISAPPQINNITNIYKPFKWGDFKQIVYSLRLADSRLDYFKNHTQ

SEQ ID NO: 442 - DNA, 1460 bp, Panicum virgatum
  misc_feature (1)..(1460): Ceres Clone ID no. 1831422
  misc_feature (1)..(1460): Encodes the peptide sequence at SEQ ID NO. 443
gcagcggtagcacaggcaggcaggcacagctagctcccgatcagctagagcttcgttaagcgttccttgttgcgcgcgcactcggctccagcgagttcgaattcttgcgcagcttgctatagcctgttcgacagccgggagctgagccaacctgccatgccggccttcgcggggggcggcgcagcggagccgccgctggcggacagctaccacgcgctgctccggcgctgcggcggcgacgacgatggtgcgcgcgcggcagtggcggcggcgccgcccgtggcggagtgcgagctcccgatgatcgacgtcgggtgcctgacgggcgggggcggcgccggctcggaggcggagcgggcggcgtgcgcggcggccatcgcgcgcgcggcggaggagtggggcttcttccaggtgcgcaaccacggcgtggcgccggagctcctggacgcgatgcggcgggagcaggcgcgcctgttccgcctgccgttcgaggccaaggcctcggccggcctgctcggcggctcctaccgctggggcaccccgaccgcgacgtcgccgcggcagctctcctggtccgaggccttccacgtcccgctcgccgccgtctccggcgacgcctgcgacttcggcggcctcaccaccctgagggacgtgacgcgggaggtggcgggcgccatgtcgaagctggccggcacgctggcgcgcgtgctggccgaggccctccgccccggcggcgccgctggggagcagcgcttcccggaggggtgcgacgagacgacgtgcttcctccggctgaaccggtacccgccgtgccccgtctcggcggacggcgccgccttcggcctggtgccgcacaccgacagcgacttcctcaccgtgctctgccaggaccacgtcggcggcctgcagctcatgaagggcgccgccgggtgggtggccgtcaagccaatccccggcgccctcatcgtcaacgtcggggacctcttccaggcgtggagcaacaacaggtacaagagcgtggagcacaaggtgatgaccaacgcgacgaccgagcgctactcggtcgccttcttcctctgcccgtcccacgactcgcccatcggcacgtgcgcggagccttctccttacaggacgttcacgttcggggagtacagacggaaggtgcgggaagacgtcaagagaaccgggaagaagatcgggctccccaatttcctcatctaggtttgcatgcgcgacgatgttagtctacaaatccttcccacaaacccatcattgtttcattctggcccttgtcatgtcaacccatgcatgtttctttctgtataccagcagcattatacagtggagagtgcagtgtgattggtgcagtgattagttactagctagctagctagctaggttgtagcttaattgatgtagccagctactagcccacacaagaaagtagtaggatctatacc

SEQ ID NO: 443 - protein, 354 aa, Panicum virgatum
  misc_feature (1)..(354): Ceres Clone ID no. 1831422
  misc_feature (211)..(309): Pfam Name: 2OG-FeII_Oxy Pfam Description: 2OG-Fe(II) oxygenase superfamily
  misc_feature (1)..(354): Bit score of 112.0 for HMM based on sequences of Figure 5
  misc_feature (1)..(354): Functional Homolog Of SEQ ID NO. 287
MPAFAGGGAAEPPLADSYHALLRRCGGDDDGARAAVAAAPPVAECELPMIDVGCLTGGGGAGSEAERAACAAAIARAAEEWGFFQVRNHGVAPELLDAMRREQARLFRLPFEAKASAGLLGGSYRWGTPTATSPRQLSWSEAFHVPLAAVSGDACDFGGLTTLRDVTREVAGAMSKLAGTLARVLAEALRPGGAAGEQRFPEGCDETTCFLRLNRYPPCPVSADGAAFGLVPHTDSDFLTVLCQDHVGGLQLMKGAAGWVAVKPIPGALIVNVGDLFQAWSNNRYKSVEHKVMTNATTERYSVAFFLCPSHDSPIGTCAEPSPYRTFTFGEYRRKVREDVKRTGKKIGLPNFLI

SEQ ID NO: 444 - protein, 333 aa, Ricinus communis
  misc_feature (1)..(333): Public GI ID no. 255548359
  misc_feature (170)..(274): Pfam Name: 2OG-FeII_Oxy Pfam Description: 2OG-Fe(II) oxygenase superfamily
  misc_feature (1)..(333): Bit score of 407.2 for HMM based on sequences of Figure 5
  misc_feature (1)..(333): Functional Homolog Of SEQ ID NO. 287
MVVPSPTPMRIKKTKAVGIPTVDLSLNRSIVSELIVRACEDYGFFKVVNHGVNKEVVARLEEEGSDFFAKPAKEKQRAGPATPFGYGCKNIGCNGDMGELEYLLLQTNPVSVAERSKTVSVDPAKFSCAVNDYIEEVRELACEILDLLGEGLWMKDKFVFSRLIRDVHSDSVLRLNHYPSAVKEVMDWDPSPKRIGFGEHSDPQILTILRSNDVAGLQICLHDGLWVPVPPDPTGFFLIVGDALQVLTNGRLMSVRHRALANSNKSRMSMMYFGAPPLNTWISPLQEMVSPQNPTRYKPFTWGEFKKAAYSLRLGDSRLDLFKIHSTDRIASC

SEQ ID NO: 445 - protein, 353 aa, Oryza sativa
  misc_feature (1)..(353): Public GI ID no. 115465423
  misc_feature (1)..(353): Oryza sativa Japonica Group
  misc_feature (180)..(290): Pfam Name: 2OG-FeII_Oxy Pfam Description: 2OG-Fe(II) oxygenase superfamily
  misc_feature (1)..(353): Bit score of 419.5 for HMM based on sequences of Figure 5
  misc_feature (1)..(353): Functional Homolog Of SEQ ID NO. 287
MVAITAPSSIEHIPLVRCPKGANAGPQAVIPCIDLSAPGAAAAVADACRTLGFFKATNHGVPAGLADALESSAMAFFALPHQEKLDMSGPARPLGYGSKSIGSNGDVGWLEYLLLSAGAASSGGAALPAALRAAVEAYTGAVRGVGCRVMELMAEGLGLGASEEGRCVLRRMVVGCEGSDEMLRVNHYPPCLLPPGRDRDECGVTGFGEHTDPQIISVLRSNCTAGLQILLRGDYSSPARWVPVPPDPDSFFVNVGDSLQVLTNGRFRSVKHRVLAPEGEESRLSVIYFGGPAASQRIAPLEQVMREGEQSLYREFTWGEYKKAAYKTRLGDNRLGPYELQHAAANDEAATKK

SEQ ID NO: 446 - protein, 327 aa, Glycine max
  misc_feature (1)..(327): Public GI ID no. 255644878
  misc_feature (173)..(274): Pfam Name: 2OG-FeII_Oxy Pfam Description: 2OG-Fe(II) oxygenase superfamily
  misc_feature (1)..(327): Bit score of 562.2 for HMM based on sequences of Figure 5
  misc_feature (1)..(327): Functional Homolog Of SEQ ID NO. 287
MVLLSKATTEQYSYIKNCMPTKFSSTIPIVDLSKPDAKTLIVKACEEFGFFKVINHGVSMEAISELEYEAFKFFSMSLNEKEKVGPPNPFGYGSKKIGHNGDVGWIEYLLLNTNQEYNFSVYGKNPEKFRCLLNSYMSSVRKMACEILELMAEGLKIQQKDVFSKLLMDKQSDSIFRVNHYPACPEMTLNDQNLIGFGEHTDPQIISLLRSNNTSGLQIYLRDGNWISVPPDDKSFFINVGDSFQVMTNGRFRSVRHRVLANGFKSRLSMIYFGGPPLSEKIAPLSFFMKGKESLYKEFTWFEYKKSIYGSRLFKNRLEHFERIAAS

SEQ ID NO: 447 - protein, 254 aa, Pisum sativum
  misc_feature (1)..(254): Public GI ID no. 6478200
  misc_feature (174)..(253): Pfam Name: 2OG-FeII_Oxy Pfam Description: 2OG-Fe(II) oxygenase superfamily
  misc_feature (1)..(254): Bit score of 419.0 for HMM based on sequences of Figure 5
  misc_feature (1)..(254): Functional Homolog Of SEQ ID NO. 287
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQEHNFSLYGEDIDKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKV

SEQ ID NO: 448 - DNA, 1667 bp, Panicum virgatum
  misc_feature (1)..(1667): Ceres Clone ID no. 1831239
  misc_feature (1)..(1667): Encodes the peptide sequence at SEQ ID NO. 449
accacaagtgcaaacgtgcaacacaataacgccctcccctgcctctcgctgctctccggctagtttggctagctgctccctgttcctactctgcttcgctcactgcagctgacaagctgagctgagctccctcccctgtttgcacgtatacaagacacgaggagaaagacggtagccgagtagagagcccgcgcgctcgttggccatggtagcgatcacggcgccgagctcgatggagcagatcccgctgatgcggtgccccaaggccaatgcgggccaggcgggcgcggccatcccgtgcgtcgacctgtcggcgccgggcgcggcggcggcggtggcggacgcgtgccgcagcgtgggcttctttcgggcgaccaaccacggcgtgccggcgggcgtcggcgaggcgctggagtcccgcgcgatggcgttctttgcgctgcccgcccaggacaaggtggacatgtccggcgccgcccggcccctgggctacggcagcaagaccatcggctccaacggcgacgtcgggtggctggagtacctcctgctgtccgtcagctccaactccgtcaaggtctcctccctgccgccgccactccgggcggcattggaggagtacacggcggcggtgcgcgaggtgggcgcgcgggtgctggagctgatagcggaggggctcggcgtggaccgggcgctgctgcggtcgatggtggtggagcgggagggcggcgacgagctggtgcgggtgaaccactacccgccctgcccgctgcgggcgccgggggactgcggcgtgacggggttcggggagcacacggacccgcagatcatctccgtgctcaggtccaactgcaccgcgggcctgcagatcaagctccgggacggcaggtgggtccccgtgccccccgacccggaatccttcttcgtcaacgtcggagactcgctgcaggtcctgacgaacgggcggttccggagcgtgaagcaccgggtggtggcgccggagggggcgcagtcgcggctgtccgtgatctacttcggcgggacggcagcgtcgcagcggatcgcgccgctgccgcaggtgatgcgggacggggagcagagcctgtaccgggagttcacctggggcgagtacaagcgcgccgcctacaagacccgcctcgccgaccaccgcctcggccccttcgagctgcgcgccgccgccagcagcgagcccgccgatccgcagccgcactgcagcaccagcaccagcacctgcatgccgccccagcagcagcagcaggtggcgcaggtgtactagctgggacctgggacaggcgtgccaggctaggctctggctgcagccggagccccctctgctggatggaatcatcgattcgacctcgccttttgtagcagtaaccctggtgttgtctgttgcctcatgcctgggactggccggtccaggactggcacctgcaggcctgcttcttctctcgctcgctgcgggctctgtgccagagcttgacggccttgaccactgccctgcctgcgtgtacatgccgggccgtccttgtaacttacttcccgtagtagtagttactgtttgtgtgcatgctgccacttttgttacttactgtgctctactttaaccggctggcagttgctaattacttcaattaggctgcggatgt

SEQ ID NO: 449 - protein, 362 aa, Panicum virgatum
  misc_feature (1)..(362): Ceres Clone ID no. 1831239
  misc_feature (175)..(276): Pfam Name: 2OG-FeII_Oxy Pfam Description: 2OG-Fe(II) oxygenase superfamily
  misc_feature (1)..(362): Bit score of 434.2 for HMM based on sequences of Figure 5
  misc_feature (1)..(362): Functional Homolog Of SEQ ID NO. 287
MVAITAPSSMEQIPLMRCPKANAGQAGAAIPCVDLSAPGAAAAVADACRSVGFFRATNHGVPAGVGEALESRAMAFFALPAQDKVDMSGAARPLGYGSKTIGSNGDVGWLEYLLLSVSSNSVKVSSLPPPLRAALEEYTAAVREVGARVLELIAEGLGVDRALLRSMVVEREGGDELVRVNHYPPCPLRAPGDCGVTGFGEHTDPQIISVLRSNCTAGLQIKLRDGRWVPVPPDPESFFVNVGDSLQVLTNGRFRSVKHRVVAPEGAQSRLSVIYFGGTAASQRIAPLPQVMRDGEQSLYREFTWGEYKRAAYKTRLADHRLGPFELRAAASSEPADPQPHCSTSTSTCMPPQQQQQVAQVY

SEQ ID NO: 450 - DNA, 1161 bp, Gossypium hirsutum
  misc_feature (1)..(1161): Ceres Clone ID no. 1918532
  misc_feature (1)..(1161): Encodes the peptide sequence at SEQ ID NO. 451
gtcttacttctctccgcttccatcctttcttgttgcagacccttcttttttttccattttttaataaaaaatacttaacagtcatggtagtggctccaccaaacccggttcgatccgaaaagccggaaccgatcgaattaccggtgatagacctttcagccgatagatcagaggtgtcaaagctcatcgtaaaagcctgcgaacaatacgggttcttcaaggcggtccaccacggtgtctccgacgatgttatcgccgcaatggaagaagaaggtctgggctttttcacgaagccggtttgcgaaaagcaaagggctggaccggccggtcctttcggttatggcattaagagcattggtttcaatggtgatagtggagaagttgaatatcttcttcttcataccaacccttcttccattagtcagttatcacacaccatctccgatgaccccaaaaagttcagctccgccgtgagcggctacatagaagcggttaagcgattagcatgtgaaatcttggatctgatggcagaaggattaggggtccatgatccatcactgttaagcaacatgatcagggacgtcgacagcgactccatgttcaggctcaatcgctatccaccttcctcattccacacaccacctccaccgcaccgcgccaccaccgaaatagggttcggggaacacaccgaccctcagatgttgaccatcctcagatcaaacgacgtgggtggcctacagatttgtgtagccggtgggacctgggtccccgtcacccctgaccctactgccttctgcatcaacgtaggtgatgttttacaggcaatgacaaatgggaggttcatgagcgtaaggcacagagcattgaccaatgggttcaagtatagaatgtcaatggcatattttggggcgccaccaccccgtgcatggctcagtgtcccaccagaactggtcacaccccataggccattgctgtataggcccttcaattgggctgagtacaagaaagcttcttattctcttcgccttggtgatagccgccttcaactttttctcaaatgaaaaacaaaactgtgttcggtttgagtttaagtcgcactaattgtgttaagaatttgtcttcttttcttataatttatcgaccaatgttttcttatgctgc

SEQ ID NO: 451 - protein, 325 aa, Gossypium hirsutum
  misc_feature (1)..(325): Ceres Clone ID no. 1918532
  misc_feature (170)..(275): Pfam Name: 2OG-FeII_Oxy Pfam Description: 2OG-Fe(II) oxygenase superfamily
  misc_feature (1)..(325): Bit score of 370.8 for HMM based on sequences of Figure 5
  misc_feature (1)..(325): Functional Homolog Of SEQ ID NO. 287
MVVAPPNPVRSEKPEPIELPVIDLSADRSEVSKLIVKACEQYGFFKAVHHGVSDDVIAAMEEEGLGFFTKPVCEKQRAGPAGPFGYGIKSIGFNGDSGEVEYLLLHTNPSSISQLSHTISDDPKKFSSAVSGYIEAVKRLACEILDLMAEGLGVHDPSLLSNMIRDVDSDSMFRLNRYPPSSFHTPPPPHRATTEIGFGEHTDPQMLTILRSNDVGGLQICVAGGTWVPVTPDPTAFCINVGDVLQAMTNGRFMSVRHRALTNGFKYRMSMAYFGAPPPRAWLSVPPELVTPHRPLLYRPFNWAEYKKASYSLRLGDSRLQLFLK

SEQ ID NO: 452 - protein, 341 aa, Hordeum vulgare
  misc_feature (1)..(341): Public GI ID no. 49065956
  misc_feature (1)..(341): Hordeum vulgare subsp. vulgare
  misc_feature (192)..(291): Pfam Name: 2OG-FeII_Oxy Pfam Description: 2OG-Fe(II) oxygenase superfamily
  misc_feature (1)..(341): Bit score of 412.2 for HMM based on sequences of Figure 5
  misc_feature (1)..(341): Functional Homolog Of SEQ ID NO. 287
MVVLAKGELEQIALPAAQPPLAHVRAIDLSAAPGPGRDAAARALVSACEEQGFFKVTGHGVPLELVRAVEAAAAEFFALPQAEKEAAAGRPLGYGSKRIGVSGDLGWIEYLLLGVTPAGALPAASFASWTLPCAGAAVASSSEHPCPLRDLLEEYAAAVRRMACGVLELMAEGLGIGPADALSRLVSDGESDNMLRVNHYPPRPEMQGCLLTGFGEHTDPQIISVLRSNGTSGLEICARDGEWTSVPPDPDAFFVNVADALQVLTNGRFSSVKHRVVVSSERPRVSMIFFGGPPMGERLAPLRQLLGDGGRSKYREFTWKEYKSSTHKGRLATDRLCSFEN

SEQ ID NO: 453 - protein, 341 aa, Hordeum vulgare
  misc_feature (1)..(341): Public GI ID no. 326532306
  misc_feature (1)..(341): Hordeum vulgare subsp. vulgare
  misc_feature (192)..(291): Pfam Name: 2OG-FeII_Oxy Pfam Description: 2OG-Fe(II) oxygenase superfamily
  misc_feature (1)..(341): Bit score of 411.7 for HMM based on sequences of Figure 5
  misc_feature (1)..(341): Functional Homolog Of SEQ ID NO. 287
MVVLAKGELEQIALPAAQPPLAHVRAIDLSAAPGPGRDAAARALVSACEEQGFFKVTGHGVPLELVRAVEAAAAEFFALPQAEKEAAAGRPLGYGSKRIGVSGDLGWIEYLLLGVTPAGALPAASFASWTLPCAGAAVASSSEHPCPLRDLLEEYAAAVRRMACGVLELMAEGLGIGPADALSRLVSDGESDNMLRVNHYPPRPEMQGRLLMGFGEHTDPQIISVLRSNGTSGLEICARDGEWTSVPPDPDAFFVNVADALQVLTNGRFSSVKHRVVVSSERPRVSMIFFGGPPMGERLAPLRQLLGDGGRSKYREFTWKEYKSSTHKGRLATDRLCSFEN

SEQ ID NO: 454 - protein, 326 aa, Triticum aestivum
  misc_feature (1)..(326): Public GI ID no. 327179123
  misc_feature (175)..(276): Pfam Name: 2OG-FeII_Oxy Pfam Description: 2OG-Fe(II) oxygenase superfamily
  misc_feature (1)..(326): Bit score of 534.4 for HMM based on sequences of Figure 5
  misc_feature (1)..(326): Functional Homolog Of SEQ ID NO. 287
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVESASLSGACTVPSCALFRAALNECIAAVRKVAVRVMKAMAEGLGIAPVDALSAMVTAGGSDQVFRVNRYPPGHALQGLGCSATGFGEHTDPQLISVLRSNGTSGLQIALQNGQWVSVPSDRDAFFINVGDSLQVLTNGRFKSVKHRVVANSLKSRVSMIYFGGPAMTQRIAPLPQLLGAGEQSLYKDFTWGEYKKAAYNSRLGDNRLAHFHR

SEQ ID NO: 455 - DNA, 999 bp, Populus trichocarpa
  misc_feature (1)..(999): Ceres Annot ID no. 1471538
  misc_feature (1)..(999): Encodes the peptide sequence at SEQ ID NO. 456
atggtagttccttctccaacaccaatacgaaccaaaacgacgaaggctttaggaattcctactgttgatctttctcttgacaactcgagcgtatcacagttgatcgtaagagcatgcgaagaatatggattcttcaaagttataaatcatggggtcaacaaggaggtcgtgacaagactggaggaggaagcagctcgttttttcggaaaaccagccgcggagaagcaacaggctggacctgctagtccttttggatatggttgcaagaacattggctgccatggtgacacgggcgagctcgagtatcttctcctccacaccaatcttctctccgtctctgaaagatccaaaaccatctcgaacgacccttcaggattcagttgtgcggtgagtgattacataagagcagttaggcagcttgcatgtgagattcttgatcttgcggctgagggcttgtgggtcccggataaacatgtattcagtaggctcatcagagacgtccatagcgattcagttcttagacttaatcactatcctgcagtcgaagagatcgcagattgggacccatcacctataagaattggttttggtgagcactccgaccctcagatcttgaccatcttgcgatccaacgatgttgcgggcctccaaatttgcttgcatgatggtttgtgggtacccgtccctcctgactccacaggattctacgtgattgtgggtgattcctttcaggttttaaccaatgggagatttgaaagcgtgaggcatagggtattgacaaactcgagccagccaagaatgtcaatgatgtattttggggcaccaccccttactgcatggatcgctcctctctcacacatggtttcacagcaaaatccaagcctttataaacccttcacttggagtgaattcaagaaagctgcctactctctacgtttgagagatacgcgtcttgacctcttcaagattcacgccactgaaaaatctgcttcattgtaa

SEQ ID NO: 456 - protein, 332 aa, Populus trichocarpa
  misc_feature (1)..(332): Ceres Annot ID no. 1471538
  misc_feature (170)..(273): Pfam Name: 2OG-FeII_Oxy Pfam Description: 2OG-Fe(II) oxygenase superfamily
  misc_feature (1)..(332): Bit score of 420.0 for HMM based on sequences of Figure 5
  misc_feature (1)..(332): Functional Homolog Of SEQ ID NO. 287
MVVPSPTPIRTKTTKALGIPTVDLSLDNSSVSQLIVRACEEYGFFKVINHGVNKEVVTRLEEEAARFFGKPAAEKQQAGPASPFGYGCKNIGCHGDTGELEYLLLHTNLLSVSERSKTISNDPSGFSCAVSDYIRAVRQLACEILDLAAEGLWVPDKHVFSRLIRDVHSDSVLRLNHYPAVEEIADWDPSPIRIGFGEHSDPQILTILRSNDVAGLQICLHDGLWVPVPPDSTGFYVIVGDSFQVLTNGRFESVRHRVLTNSSQPRMSMMYFGAPPLTAWIAPLSHMVSQQNPSLYKPFTWSEFKKAAYSLRLRDTRLDLFKIHATEKSASL

SEQ ID NO: 457 - protein, 334 aa, Ipomoea nil
  misc_feature (1)..(334): Public GI ID no. 284468804
  misc_feature (178)..(280): Pfam Name: 2OG-FeII_Oxy Pfam Description: 2OG-Fe(II) oxygenase superfamily
  misc_feature (1)..(334): Bit score of 584.9 for HMM based on sequences of Figure 5
  misc_feature (1)..(334): Functional Homolog Of SEQ ID NO. 287
  misc_feature (182)..(182): Xaa is any aa, unknown, or other
MVVLSKPAIEQFSIVKPCKGGAFPPGIPLIDLSHPDCKHHLVKACEEFGFFKVVNHGVPTEFITRLESEAVKFFSSPLSDKENAGPPDPSGYGNKTIGPNGDIGWVEYILLSPNDVEFDYDRFSSVVGLSPEMFRAAVSDYVTAVKRMACEILELMAEGLRIQPKNALSRLVMDEESDSVLXLNHYPPCPELQEINGRNLIGFGEHTDPQIISVLRSNNTSGLQISLKDGCWISVPADQSSFFINVGDSLQVMTNGRFKSVRHRILTNSRKSRLSMIYFGGPPLSEKIAPLPSLIQGGEDSLYKEFTWFEYKKSVYKSRLADNRLVRFQNITAS

SEQ ID NO: 458 - protein, 327 aa, Vigna angularis
  misc_feature (1)..(327): Public GI ID no. 67077814
  misc_feature (173)..(274): Pfam Name: 2OG-FeII_Oxy Pfam Description: 2OG-Fe(II) oxygenase superfamily
  misc_feature (1)..(327): Bit score of 566.7 for HMM based on sequences of Figure 5
  misc_feature (1)..(327): Functional Homolog Of SEQ ID NO. 287
MASLSKTTTEQYSYIKNRMASTFASTIPIVDLSKPDAKTLIVNACEEFGFFKVINHGVPMEAISRLETEALKFFSLPLNEKEKAGPPNPFGYGSKRIGHNGDVGWVEYLLLNNNQEHDFSLYGKNHEKFRCLLNSYMCSVRKMACDILELMAEGLKIQQKNVFSKLLRDKESDSVFRVNHYPACPELAVNGENMIGFGEHTDPQIISLLRSNNTSGLQIYLRDGSWISVPPDHNSFFINVGDSLQVMTNGRFRSVRHRVLANGFKSRLSMIYFGGPPLSEKIVPLPSLMKGKESLYKEFTWFEYKNSTYGSRLADNRLGHFERIAAS

SEQ ID NO: 459 - protein, 322 aa, Populus trichocarpa
  misc_feature (1)..(322): Public GI ID no. 224101511
  misc_feature (158)..(267): Pfam Name: 2OG-FeII_Oxy Pfam Description: 2OG-Fe(II) oxygenase superfamily
  misc_feature (1)..(322): Bit score of 377.9 for HMM based on sequences of Figure 5
  misc_feature (1)..(322): Functional Homolog Of SEQ ID NO. 287
MVVASPTKLHSEEHLAIELPTVDLSGDRSMVSNLIVKACEEYGFFKVKNHGVPHDIIAQMEKESFNFFAKPFDEKQKVEPAKPFGYGCKNIGFNGDMGEVEYLLLNINPLSIAESSAVSAYIEAVRELACELLDLMAEGLRVPDRSVFSRLIRDVDSDSLIRLNHYPPMPLLCKDEDSSPCNQNKVGFGEHSDPQILTILRSNDVGGLQISLNDGAWVPVTPDPATFWVNVGDLLQAMTNGRFVSVRHKALTNSSKSRMSMAYFAGPPPNARITVPPEMITPTKPALYKPFTWAEFKKAAYAMRLGDRRLGLFRMEGDEQVA

SEQ ID NO: 460 - protein, 339 aa, Medicago truncatula
  misc_feature (1)..(339): Public GI ID no. 87240601
  misc_feature (196)..(293): Pfam Name: 2OG-FeII_Oxy Pfam Description: 2OG-Fe(II) oxygenase superfamily
  misc_feature (1)..(339): Bit score of 143.0 for HMM based on sequences of Figure 5
  misc_feature (1)..(339): Functional Homolog Of SEQ ID NO. 287
MDPVSDPPFEEAYKILLNKTKNNRNNVPNDNKFPVVEECELPVIDLSRLEDDNEMVREACKYEIARASQEWGFFQVINHGIPNDIFSRLKCEQEKVFKLPFDKKTKEDKFLQFSSGSYRWGTPSATCVGQLSWSEAFHIPLKDVLESNAQPNTLRSTIEQFAIISSNLAQTLAHILAEKMGHESTYFKENCLPNTCYLRLNRYPPCPIASEIHGLMPHTDSDFLTILYQDQVGGLQLVKDKKWIAVKPNPSALIINIGDLFQAWSNGLYKSVEHRVVTNPKVERFSMAYFLCPSNESVIESCKKPSLYKEFSFQEYRQQVRDDVQKLGTKIGLPRFLLF

SEQ ID NO: 461 - DNA, 1102 bp, Glycine max
  misc_feature (1)..(1102): Ceres Clone ID no. 467671
  misc_feature (1)..(1102): Encodes the peptide sequence at SEQ ID NO. 462
  misc_feature (516)..(516): n is a, c, t, g, unknown, or other
gacagacttcctttgctcaaagccraaccaaattttctctctttcacttatttattgactccccaaaagcttttcaaatatctctgttcctctctcacgtaccttctccctatctttcactccacttcttaacaccacaaaacagaataacggccgagcaaacaacaagaaaaatggtgttgttgtccaaagcaacaacagaacaatactcctacattaagaactgcatgccaaccaaattttcctcaacaattcccatagtggacctctccaaacctgatgcaaagacccttatagtgaaggcttgtgaggagtttggattcttcaaagtcatcaatcatggtgtctccatggaagctatatccgaattggaatatgaagccttcaaattcttctctatgtcactcaatgaaaaggaaaaagtaggacctcccaatccatttgggtatggtagcaagaaaattggacacaatggggacgttggttggattgagtaccttcttctyaacaccaatnaagaacacaacttctctgtttatggcaaaaaccctgagaaattyaggtgtctgttgaacagttacatgtyttctgtgaggaasaycscatgtgagattcttgagttgatggcagaagggtkgawgattcagcaaaaggatgtgtttagcaagcttctaatggataaacaaagtgactctattttcagggtgaatcattaccctgcttgtcctgaaatgactytsaatgatcagaacttgattgggtttggagaacacacakacccacaaatcatctctctgttaagatccaacaacacttcaggccttcagatttatcttakagatggaaattggatttcagtcccaccagatgacaaatcctttkttattaacgttggtgattctcttcaggtwcaacataaagcatgctattgatgcatactaaaaagttaaatgagaaaattctcatttttctttctccttatgactttcatatttctatggataagtataaataaataaatatacaaactcctcttttaagtgccttttggaaaatgtgtgctaaaattttggttaagttgttaattattgcattttcattc

SEQ ID NO: 462 - protein, 252 aa, Glycine max
  misc_feature (1)..(252): Ceres Clone ID no. 467671
  misc_feature (173)..(245): Pfam Name: 2OG-FeII_Oxy Pfam Description: 2OG-Fe(II) oxygenase superfamily
  misc_feature (1)..(252): Bit score of 379.7 for HMM based on sequences of Figure 5
  misc_feature (1)..(252): Functional Homolog Of SEQ ID NO. 287
  misc_feature (111)..(111): Xaa is any aa, unknown, or other
  misc_feature (115)..(115): Xaa is any aa, unknown, or other
  misc_feature (129)..(129): Xaa is any aa, unknown, or other
  misc_feature (138)..(138): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
  misc_feature (155)..(155): Xaa is any aa, unknown, or other
  misc_feature (156)..(156): Xaa is any aa, unknown, or other
  misc_feature (189)..(189): Xaa is any aa, unknown, or other
  misc_feature (202)..(202): Xaa is any aa, unknown, or other
  misc_feature (222)..(222): Xaa is any aa, unknown, or other
  misc_feature (237)..(237): Xaa is any aa, unknown, or other
  misc_feature (246)..(246): Xaa is any aa, unknown, or other
MVLLSKATTEQYSYIKNCMPTKFSSTIPIVDLSKPDAKTLIVKACEEFGFFKVINHGVSMEAISELEYEAFKFFSMSLNEKEKVGPPNPFGYGSKKIGHNGDVGWIEYLLXNTNXEHNFSVYGKNPEKXRCLLNSYMXSVRXXXCEILELMAEGXXIQQKDVFSKLLMDKQSDSIFRVNHYPACPEMTXNDQNLIGFGEHTXPQIISLLRSNNTSGLQIYLXDGNWISVPPDDKSFXINVGDSLQXQHKACY

SEQ ID NO: 463 - protein, 343 aa, Nicotiana tabacum
  misc_feature (1)..(343): Public GI ID no. 134303286
  misc_feature (178)..(281): Pfam Name: 2OG-FeII_Oxy Pfam Description: 2OG-Fe(II) oxygenase superfamily
  misc_feature (1)..(343): Bit score of 568.4 for HMM based on sequences of Figure 5
  misc_feature (1)..(343): Functional Homolog Of SEQ ID NO. 287
MVVLTQPLVETLSHIKTCKYNNTDVFTGIPVIDLSDPEANTLIIKACQEFGFFKVVNHGVPIEIMTKLESEAVNFFNLSQVEKDKAGPANPFGYGNKRIGSNGDVGWVEYLLLTTNPDLSYHKSIAIPGNSHLFWSLVNEYVSAVRNLACLALEKIAEGLRIEPKNVLSKMLRDEKSDSCFRLNHYPPFPELLQTLSGRNLIGFGEHTDPQVISVVRSNNTSGLQISLKDGTWLSVPPDPYSFFINVDDSLQVMSNGRFRSVRHRVLADSMKSRVSMIYFGGPPLSEKIAPLSCLMEEGEESLYNEFTWCEYKKSAYKTRLGDNRLALFEKKPQTKPATSAAQ

SEQ ID NO: 464 - protein, 308 aa, Rumex palustris
  misc_feature (1)..(308): Public GI ID no. 109729791
  misc_feature (152)..(254): Pfam Name: 2OG-FeII_Oxy Pfam Description: 2OG-Fe(II) oxygenase superfamily
  misc_feature (1)..(308): Bit score of 546.0 for HMM based on sequences of Figure 5
  misc_feature (1)..(308): Functional Homolog Of SEQ ID NO. 287
MALFPLIPVIDLSKPDAKHQIAKACEDFGFFKVINHGVPMDSIKKLESEAVKFFSLPLSEKEKAGPPYPVGFGYGNKRIGLNGDVGWVEYLLMTTKSNPEIGDNPEDFRCAMNQYVAAVKSMACDVLELMADGLRIQQKDVFSKLLMDEQSDSMFRVNHYPPYPELQGFKDRNLVGFGEHTDPQIISVLRSNNTSGLEISLRDGSWVSVPPDQTSFFINVGDSLQVMTNSKFKSVRHRVLANSYKSRVSMIYFGGPPMSERIAPLPSLMGVEQTSLYKEFTWYEYKATSHKSRLADNRLVPFEKIAAS

SEQ ID NO: 465 - protein, 365 aa, Simkania negevensis
  misc_feature (1)..(365): Public GI ID no. 338733586
  misc_feature (1)..(365): Simkania negevensis Z
  misc_feature (181)..(280): Pfam Name: 2OG-FeII_Oxy Pfam Description: 2OG-Fe(II) oxygenase superfamily
  misc_feature (1)..(365): Bit score of 80.4 for HMM based on sequences of Figure 5
  misc_feature (1)..(365): Functional Homolog Of SEQ ID NO. 287
MKQFFSFIALLFSSVLIAQASPIPTLHLEDYANPVKREEFIASLEEAVQGVGYFFVDGFPVESKAINRAYEQAKNFFASDKKHDYLSSNGHRGYLPGESAKGETRVDFKEFYHIGRELASEDLERLQYEKNVWPENRKEFRFAMESLFARIDIFKNKLGEAFSELLDQKKGFLLDMIQQGDSLMRISHYPANPPEDAIWAGTHTDINLFTLYPRASAQGLQVQAKDGSWIDINVPEGMVFVHCGDMLENLSNGLCKAAVHRVVDNGLSEDRYAIIFFVHPRIDDRLDPLPSCIEKTGGARHYANLSRAELLTERLIDLGLANKQMMELFVRSGAIQKLKEVNRFSSKAETALKKAGLITLQLELQ

SEQ ID NO: 466 - protein, 371 aa, Oryza sativa
  misc_feature (1)..(371): Public GI ID no. 125553301
  misc_feature (1)..(371): Oryza sativa Indica Group
  misc_feature (180)..(290): Pfam Name: 2OG-FeII_Oxy Pfam Description: 2OG-Fe(II) oxygenase superfamily
  misc_feature (1)..(371): Bit score of 349.8 for HMM based on sequences of Figure 5
  misc_feature (1)..(371): Functional Homolog Of SEQ ID NO. 287
MVAITAPSSIEHIPLVRCPKGANAGPQAVIPCIDLSAPGAAAAVADACRTLGFFKATNHGVPAGLADALESSAMAFFALPHQEKLDMSGPARPLGYGSKSIGSNGDVGWLEYLLLSAGAASSGGAALPAALRAAVEAYTGAVRGVGCRVMELMAEGLGLGASEEGRCVLRRMVVGCEGSDEMLRVNHYPPCLLPPGRDRDECGVTGFGEHTDPQIISVLRSNCTAGLQILLRGDYSSPARWVPVPPDPDSFFVNVGDSLQVLTNGRFRSVKHRVLAPEGEESRLSVIYFGGPAASQRIAPLDHGDAGGGAEPVQGVHLGGTVGETMAGAVAAAPMDGDICASWWDVIIPRAMLCIEAVDGRISGSTSSYGS

SEQ ID NO: 467 - protein, 322 aa, Solanum lycopersicum
  misc_feature (1)..(322): Public GI ID no. 116672836
  misc_feature (164)..(268): Pfam Name: 2OG-FeII_Oxy Pfam Description: 2OG-Fe(II) oxygenase superfamily
  misc_feature (1)..(322): Bit score of 572.8 for HMM based on sequences of Figure 5
  misc_feature (1)..(322): Functional Homolog Of SEQ ID NO. 287
MVILSKQTSFFNGVPLIDLSKPDSKNLIVNACEEFGFFKIINHDVPMEFISKLESEAIKFFSSPLSEKLKAGPADPFGYGNKQIGTNGDCGRVEHILVSTNSEFNYQKFASILGVNPENIRAAVNDYVSAVKKMSCDILEMLAEGLKIYPTNVFSKLLMDENSDSVFRLNHYPPCSEIERLNDNNNDLIGFGEHTDPQIISILRSNNTSGLQILLKDGHWISVPPDENSFFVNVGDSLQVMTNGRFKSVKHRVLANSVKSRLSMIYFGGPPLSEKIAPLASLMEGEDSSLYKEFTWFEYKKSAYKTRLADNRLILFEKIAAS

SEQ ID NO: 468 - protein, 342 aa, Prunus salicina
  misc_feature (1)..(342): Public GI ID no. 327359295
  misc_feature (180)..(281): Pfam Name: 2OG-FeII_Oxy Pfam Description: 2OG-Fe(II) oxygenase superfamily
  misc_feature (1)..(342): Bit score of 580.9 for HMM based on sequences of Figure 5
  misc_feature (1)..(342): Functional Homolog Of SEQ ID NO. 287
MVVLSQPAALDHLSDLIKACKPTSLFTGIPVVDLSDPEAKHHIVKACEDYGLFKLVNHGVPLDFMTTLEAQALKFFNLPQSEKEKAGPAEPFGYGSKRIGPNGDVGWIEYILLNTNPDIISPKSLSIFKENPEIFRDAVLDYICAVKKMTFEVLELMVDGLGIEPRNVLSNLLREDKSDCCFRLNYYPPCPELQALRGRNLIGFGEHTDPQIISVLRSNNTSGLQISLKDGTWVSVPPDQNSFFINVGDCLQVMSNGRFKSVKHRVLADTTSSRISMIFFGGPPLSEKIAPLPSLMAEGEESLYKEFTWWCEYKKSAYKSRLADYRLGLFEKSVPMMSNSQF

SEQ ID NO: 469 - protein, 334 aa, Vitis vinifera
  misc_feature (1)..(334): Public GI ID no. 297744020
  misc_feature (170)..(272): Pfam Name: 2OG-FeII_Oxy Pfam Description: 2OG-Fe(II) oxygenase superfamily
  misc_feature (1)..(334): Bit score of 408.5 for HMM based on sequences of Figure 5
  misc_feature (1)..(334): Functional Homolog Of SEQ ID NO. 287
MVVPSPSPIRSKKTKAVGIPVIDLSLNRSAIAELIVNACEDYGFFKVVNHGVPKEIIGRLEEEGLSFFAKPSSEKQKAGPASPFGYGCKNIGFNGDRGELEYLLLHTNPVSISERSKAISNDPTEFSCAVTDYIQGVRELCCEILDLIGEGLWLQDKMVFSRMIRDVHSDSVIRVNHYPAVKDVKEWDPCDPIGFGEHSDPQILTILRSNDVPGLQIRLRDGLWVPVPPDPTEFCVFVGDALEAMTNGRLMSVRHRALTSSVKARLSMMYFGAPPLNAWISPLPDMVSPQKPSLYRPFSWVEYKKAAYSLRLGDRRLDLFKINTISTTLVTRTI

SEQ ID NO: 470 - protein, 364 aa, Capsicum annuum
  misc_feature (1)..(364): Public GI ID no. 93115317
  misc_feature (173)..(313): Pfam Name: 2OG-FeII_Oxy Pfam Description: 2OG-Fe(II) oxygenase superfamily
  misc_feature (1)..(364): Bit score of 209.0 for HMM based on sequences of Figure 5
  misc_feature (1)..(364): Functional Homolog Of SEQ ID NO. 287
MVVATPTPLLRRGTKKTAAFGVPTIDLSEDKSIASEMIVKACEDYGFFKVVNHGVPKKVIARMEREAVDFFSHPIAQKGRAGPAAPFGYGCKNIGFNGDKGDLEYILLEANPISLSQRAKTMSNDPSTFSAVTNDYVSAVRKLACDILELVADGLWMENKSIFSKLISNSQNDSCLRVNHYPPFIAPNNNYNHNDNDDEELNNHWDPSSELVEEGLHISPLIPAVGSKSRVGFGEHTDPQILTILRSNDVSGLQICSHDGFWIPVPPDPNEFFVFVGDSFQALTNGRFTSVRHRVVAINSWKSRMSMMYFAAPPLDAWITAPPQINNSISSNIYRPFTWGNFKQIVYSLRLADSRLDYFTNHAQ

SEQ ID NO: 471 - protein, 372 aa, Oryza sativa
  misc_feature (1)..(372): Public GI ID no. 115456701
  misc_feature (1)..(372): Oryza sativa Japonica Group
  misc_feature (211)..(309): Pfam Name: 2OG-FeII_Oxy Pfam Description: 2OG-Fe(II) oxygenase superfamily
  misc_feature (1)..(372): Bit score of 653.0 for HMM based on sequences of Figure 1
  misc_feature (1)..(372): in Figure 1
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 472 - DNA, 1140 bp, Sorghum bicolor
  misc_feature (1)..(1140): Ceres Annot ID no. 8631464
  misc_feature (1)..(1140): Encodes the peptide sequence at SEQ ID NO. 473
atggtgcagcaggcgtcgcttggtgagccgctgctgctccagccgccgccgccgtccctggtgttcgacgccgcccgtctgagcggtctgtccgacatcccgcagcaatttctgtggcccgccgacgagagccccaccccggacgccgccgaggagctggccgtgccgctcatcgacctctccggggacgccgccgaggtggtccgccaggtgcgccgcgcctgcgacctgcacggcttcttccaggtggtgaaccacggcatcgacgacgcgctcctgcaggaggcgcaccgctgcatggacgccttcttcacgctccccatgtccgacaagcagcgcgcgcagcgccgtcagggggacagctgcggatacgccagcagcttcacgggccgcttcgcgtccaagctgccatggaaggagacgctgtcgttccgctactccgacgaccagggcgacggcgacgtcgtcgtggactacttcgtcgacaagctgggcgatgcgtaccgtcaccacggggaggtgtacggccgctactgctccgagatgagccggctgtcgctggagctgatggaggtgctcggggagagcctcggcgtgggccgccgccacttccgccgcttcttccaggggaacgactccatcatgcgcctcaactactacccgccgtgccagcggccctacgacacgctgggcaccggaccgcattgcgaccccacctccctcaccatcctccaccaggacgacgtcggaggcctccaggtgttcgacgccgccaccggccccggcaccggccgctggcgctccatcaggccccacccgggcgccttcgtcgtcaacatcggcgacaccttcatggcgctctccaacggacgctacaggagctgcctgcaccgcgccgtcgtcaacagccgggtgccccgccgctcgctcgccttcttcctgtgcccggagatggacaaggtggtgcgcccgcccgccgagctggtggacgacgccaacccgagggcgtacccggacttcacgtggcggacgctgctcgacttcaccatgaggcactacaggtccgacatgaggacgctcgaggcattctccaactggctcaaccatggcggacacctctcatcaccacctcctccatga

SEQ ID NO: 473 - protein, 379 aa, Sorghum bicolor
  misc_feature (1)..(379): Ceres Annot ID no. 8631464
  misc_feature (212)..(316): Pfam Name: 2OG-FeII_Oxy Pfam Description: 2OG-Fe(II) oxygenase superfamily
  misc_feature (1)..(379): Bit score of 673.3 for HMM based on sequences of Figure 1
  misc_feature (1)..(379): Functional Homolog Of SEQ ID NO. 471
  misc_feature (1)..(379): in Figure 1
MVQQASLGEPLLLQPPPPSLVFDAARLSGLSDIPQQFLWPADESPTPDAAEELAVPLIDLSGDAAEVVRQVRRACDLHGFFQVVNHGIDDALLQEAHRCMDAFFTLPMSDKQRAQRRQGDSCGYASSFTGRFASKLPWKETLSFRYSDDQGDGDVVVDYFVDKLGDAYRHHGEVYGRYCSEMSRLSLELMEVLGESLGVGRRHFRRFFQGNDSIMRLNYYPPCQRPYDTLGTGPHCDPTSLTILHQDDVGGLQVFDAATGPGTGRWRSIRPHPGAFVVNIGDTFMALSNGRYRSCLHRAVVNSRVPRRSLAFFLCPEMDKVVRPPAELVDDANPRAYPDFTWRTLLDFTMRHYRSDMRTLEAFSNWLNHGGHLSSPPPP

SEQ ID NO: 474 - DNA, 1279 bp, Zea mays
  misc_feature (1)..(1279): Ceres Clone ID no. 329121
  misc_feature (1)..(1279): Encodes the peptide sequence at SEQ ID NO. 475
gacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttaggg

SEQ ID NO: 475 - protein, 371 aa, Zea mays
  misc_feature (1)..(371): Ceres Clone ID no. 329121
  misc_feature (206)..(306): Pfam Name: 2OG-FeII_Oxy Pfam Description: 2OG-Fe(II) oxygenase superfamily
  misc_feature (1)..(371): Bit score of 664.9 for HMM based on sequences of Figure 1
  misc_feature (1)..(371): Functional Homolog Of SEQ ID NO. 471
  misc_feature (1)..(371): in Figure 1
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSIRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTSSNGGQHLLEKK

SEQ ID NO: 476 - protein, 365 aa, Triticum aestivum
  misc_feature (1)..(365): Public GI ID no. 75276875
  misc_feature (201)..(299): Pfam Name: 2OG-FeII_Oxy Pfam Description: 2OG-Fe(II) oxygenase superfamily
  misc_feature (1)..(365): Bit score of 699.8 for HMM based on sequences of Figure 1
  misc_feature (1)..(365): Functional Homolog Of SEQ ID NO. 471
  misc_feature (1)..(365): in Figure 1
MVQPVFDAAVLSGRADIPSQFIWPEGESPTPDAAEELHVPLIDIGGMLSGDPRATAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPMETLGTGPHCDPTSLTILHQDNVGGLQVHTEGRWRSIRPRADAFVVNIGDTFMALSNGRYKSCLHRAVVNSKVPRKSLAFFLCPEMDKVVAPPGTLVDAANPRAYPDFTWRSLLDFTQKHYRADMKTLEVFSSWIVQQQQGQLLPPLASH

SEQ ID NO: 477 - protein, 363 aa, Lolium perenne
  misc_feature (1)..(363): Public GI ID no. 13625523
  misc_feature (202)..(299): Pfam Name: 2OG-FeII_Oxy Pfam Description: 2OG-Fe(II) oxygenase superfamily
  misc_feature (1)..(363): Bit score of 694.2 for HMM based on sequences of Figure 1
  misc_feature (1)..(363): Functional Homolog Of SEQ ID NO. 471
  misc_feature (1)..(363): in Figure 1
MVQPVFDAALLSGQSDIPSQFIWPADESPSPDATEELHVPLIDIGGLLSGDRAAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEAYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPETLVDEANPRAYPDFTWRALLDFTQKHYRADMKTLEVFSDWIQQGHQPAATTTTT

SEQ ID NO: 478 - protein, 360 aa, Hordeum vulgare
  misc_feature (1)..(360): Public GI ID no. 49065946
  misc_feature (1)..(360): Hordeum vulgare subsp. vulgare
  misc_feature (202)..(299): Pfam Name: 2OG-FeII_Oxy Pfam Description: 2OG-Fe(II) oxygenase superfamily
  misc_feature (1)..(360): Bit score of 698.2 for HMM based on sequences of Figure 1
  misc_feature (1)..(360): Functional Homolog Of SEQ ID NO. 471
  misc_feature (1)..(360): in Figure 1
MVQPVFDAAVLSGRTDIPSQFIWPEGESPTPDATEEMHVPLIDIGGMLSGDPRAAAEVTRLVGEACERHGFFQVVNHGIDAQLLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNESIMRLNYYPPCQRPLETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQPASART

SEQ ID NO: 479 - protein, 359 aa, Dasypyrum villosum
  misc_feature (1)..(359): Public GI ID no. 157683559
  misc_feature (201)..(299): Pfam Name: 2OG-FeII_Oxy Pfam Description: 2OG-Fe(II) oxygenase superfamily
  misc_feature (1)..(359): Bit score of 699.8 for HMM based on sequences of Figure 1
  misc_feature (1)..(359): Functional Homolog Of SEQ ID NO. 471
  misc_feature (1)..(359): in Figure 1
MVQPVFDSAVLSGRADIPSQFIWPEGESPTPDAAEELHVPLIDIGGMLSGDPRAAAEVMRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 480 - protein, 383 aa, Lactuca sativa
  misc_feature (1)..(383): Public GI ID no. 4164141
  misc_feature (228)..(325): Pfam Name: 2OG-FeII_Oxy Pfam Description: 2OG-Fe(II) oxygenase superfamily
  misc_feature (1)..(383): Bit score of 743.5 for HMM based on sequences of Figure 1
  misc_feature (1)..(383): Functional Homolog Of SEQ ID NO. 471
  misc_feature (1)..(383): in Figure 1
MAIDCMIKTPSCMSSLKEELKEDQQRSLVFDASVLQHETNIPQQFIWPDNEKPNSKKSKDLEVPLIDLGGFLSGRSSSTKEASKLVGNACQKHGFFLVVNHGVDANLISDAQTYMDLFFELPLSEKQRAQRKAGESCGYASSFTGRFSSKLPWKETLSFRFSAEKNSADIVKDYFENTMGEEFVRLGKVYQEYCNAMSRLSLGIMELLGLSLGVNRSHFKEFFEENNSIMRLNYYPRCQKPELTLGTGPHCDPTSLTILHQDNVGGLEVFVDNEWRSITPNSNAFVVNIGDTFMALSNGRYKSCLHRAVVNNKTPRKSLAFFLCPKKDKVVSPPKELVDENNPRVYPDFTWATFLEFTQKHYRADMNTLQAFSNWVEQKTSTT

SEQ ID NO: 481 - protein, 379 aa, Helianthus annuus
  misc_feature (1)..(379): Public GI ID no. 187455574
  misc_feature (224)..(321): Pfam Name: 2OG-FeII_Oxy Pfam Description: 2OG-Fe(II) oxygenase superfamily
  misc_feature (1)..(379): Bit score of 746.7 for HMM based on sequences of Figure 1
  misc_feature (1)..(379): Functional Homolog Of SEQ ID NO. 471
  misc_feature (1)..(379): in Figure 1
MAIDCIIKNPSPMSSLKEDRQRSLVFDASVLQHEGNIPQQFIWPDHEKPNTQKSKELEVPLIDLGGFLSGHSCSTKKASNLVGEACQKHGFFLVVNHGVDENLISDAHQYMDLFFELPLSEKQRAQRKAGESCGYASSFTGRFSSKLPWKETLSFQYSADENSSDIVKDYFKDKMGEEFIRLGNVYQDYCNAMNRLSLGIMELLGMSLGVSRAHFKEFFQENNSIMRLNYYPPCQKPDLTLGTGPHCDPTSLTILHQDNVGGLEVFVDNEWRSIAPNSQAFVVNIGDTFMALSNGRYKSCLHRAVVNSKTPRKSLAFFLCPKKDKVVSPPEKLVDQKNPRIYPDFTWSTFLEFTQKHYRADMNTLKAFSNWVQQETSRT

SEQ ID NO: 482 - protein, 376 aa, Chrysanthemum x morifolium
  misc_feature (1)..(376): Public GI ID no. 190192210
  misc_feature (222)..(320): Pfam Name: 2OG-FeII_Oxy Pfam Description: 2OG-Fe(II) oxygenase superfamily
  misc_feature (1)..(376): Bit score of 724.8 for HMM based on sequences of Figure 1
  misc_feature (1)..(376): Functional Homolog Of SEQ ID NO. 471
  misc_feature (1)..(376): in Figure 1
MIKSHSSLLSSHKELMDCQKTPLVFDSLILQHETNIPQQFIWPDHEKPNLQKTKELVVPLVDLGGFLSGRPSSAKEASLVVGDACKKHGFFLVTNHGVDASLIADAHRYMDLFFELPLSDKQRAQRKLGESCGYASSFTGRFTSKLPWKETLSFQFSGEKSSANGVKDYFENTLGKEFTRLGKVYQEYCNAMSRLSLGIMELLGMSLGVHRAHFKEFFEENDSIMRLNYYPRCQKPDQTLGTGPHCDPTSLTILHQDSVGGLEVFIDNEWRSIAPNSNAFVVNIGDTFMALSNGRYKSCLHRAVVNNRIHRKSLAFFLCPKKDKVVSPPDELVDENNPRIYPDFTWSTFLEFTQKHYRADMNTLQAFSNWIQQKNS

SEQ ID NO: 483 - protein, 376 aa, Solanum dulcamara
  misc_feature (1)..(376): Public GI ID no. 7328337
  misc_feature (219)..(317): Pfam Name: 2OG-FeII_Oxy Pfam Description: 2OG-Fe(II) oxygenase superfamily
  misc_feature (1)..(376): Bit score of 742.5 for HMM based on sequences of Figure 1
  misc_feature (1)..(376): Functional Homolog Of SEQ ID NO. 471
  misc_feature (1)..(376): in Figure 1
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 484 - protein, 383 aa, Citrus sinensis
  misc_feature (1)..(383): Public GI ID no. 8919865
  misc_feature (1)..(383): Citrus sinensis x Citrus trifoliata
  misc_feature (226)..(324): Pfam Name: 2OG-FeII_Oxy Pfam Description: 2OG-Fe(II) oxygenase superfamily
  misc_feature (1)..(383): Bit score of 739.4 for HMM based on sequences of Figure 1
  misc_feature (1)..(383): Functional Homolog Of SEQ ID NO. 471
  misc_feature (1)..(383): in Figure 1
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 485 - protein, 375 aa, Capsicum annuum
  misc_feature (1)..(375): Public GI ID no. 326581983
  misc_feature (220)..(317): Pfam Name: 2OG-FeII_Oxy Pfam Description: 2OG-Fe(II) oxygenase superfamily
  misc_feature (1)..(375): Bit score of 739.8 for HMM based on sequences of Figure 1
  misc_feature (1)..(375): Functional Homolog Of SEQ ID NO. 471
  misc_feature (1)..(375): in Figure 1
MAIDCMITNGKSPMLDDKKPLVFDASKLKRESNIPTQFIWPDDEKPCAVAQELPVSLIDLRGFLSGDPVAAQQASQLVGDACRSHGFFLVVNHGVDANLISNAHRYMDTFFDMPLSEKQKAQRKIGEHCGYASSFTGRFSSKLPWKETLSFRYSAEEDSSHIVEEYFQRTLGESFSHLGNIYQEYCNSMSTLSLGIMELLGMSLGIERSHFKEFFEENESIMRLNYYPPCQKPELTLGTGPHCDPTSLTILHQDCVGGLQVFVDNEWRSISPNFNAFVVNIGDTFMALSNGRYKSCLHRAVVNNKTPRKSLAFFLCPNKDKVVSPPSKLVDSNNPRMYPDFTWPTLHEFTQKHYRADMNTLANFSNWLQHSTAQA

SEQ ID NO: 486 - DNA, 1622 bp, Gossypium hirsutum
  misc_feature (1)..(1622): Ceres Clone ID no. 1842451
  misc_feature (1)..(1622): Encodes the peptide sequence at SEQ ID NO. 487
atccatctttgttaggcctcagcatatttacgcttcatgcaatggccatcgactgcatctccaacatagcctccatgactcaccatccgaaagatgaaaaaaaagatgagcagaaaaagctggtttttgatgcctcggtgctcaagttcgaatcccagataccaaaagaatttatatggcctgatgacgaaaagccttccgctaatgcaccagaactccaagtaccactcattgacctaggaggcttcctttctggtgaccctgttgctacaatggaagcttcaaggtttatcagcgaggcatgtcagcagcatggtttcttccttgtagttaatcatggagtcgatgcaaaactcttggctgatgcccacaagtacatggataacttctttctattgccacttagacaaaagcaaagggctcaaagaaaacttggtgagcactgtggatatgccagtagcttcactggcaggttctcgaccaagctcccatggaaggaaacactttcttttcgctattcagccgagaacaactcatccaagatggtggaagactaccttgttaataaaatgggaaatgaattgaggcaactcgggagggtttaccaggactactgcgaggcgatgagcaagctttctctggggataatggagcttttagccattagtctgggcgtaggcagagcacatttccgggagttttttgataaaaatgattcaataatgagactaaactactatcccccttgtcaaaaaccagacctcactttaggaacagggcctcattgcgatccaacgtctttaaccatccttcaccaagacagagttggtggccttcaagtgtttgtagacaacgaatggcattcaattagcccaaatttcgaagcatttgtcgttaacattggcgacacctttatggcactgtcaaatgggagatataaaagttgcttgcaccaagcagtggtgaacagccataagccaagaaaatctctggctttctttttgtgtccagagggggataaagtggtaaccccaccagcagagttggtgagccagaacagtcccagagtatatccagattttacatggcctatgctgcttgaattcacacaaaagcattacagagctgacatgaacactcttcaagaattctcaaactgggttcaacagagaaacagctgaggcggtcttgtctctctctactgtctagttaaggtgtcgtcacaaaatacaaacaaaccttggcatatcactcagtcactaccctacgacaatgaattaattgaagagattggatgggtttttttgctaccagttagaaggaataaccaaaaagcaaagaaatgcccccttttttgtttcatgttcatgatgtcagagtgataacaagcttgttagtgatgaacaaatggcaagacaagagatacaaataaggaaccgcataaagagcttgattaggttttcttttttctaattttgcatcttcattgatgatacaagaaaggcaatccatagattcacctctcttcttcatgtaaaaacaaaattagggtacttgttaattagtaccatcttttttttgaagtaatttcatgcattaccaaagtgattttatattttatc

SEQ ID NO: 487 - protein, 379 aa, Gossypium hirsutum
  misc_feature (1)..(379): Ceres Clone ID no. 1842451
  misc_feature (225)..(323): Pfam Name: 2OG-FeII_Oxy Pfam Description: 2OG-Fe(II) oxygenase superfamily
  misc_feature (1)..(379): Bit score of 726.9 for HMM based on sequences of Figure 1
  misc_feature (1)..(379): Functional Homolog Of SEQ ID NO. 471
  misc_feature (1)..(379): in Figure 1
MAIDCISNIASMTHHPKDEKKDEQKKLVFDASVLKFESQIPKEFIWPDDEKPSANAPELQVPLIDLGGFLSGDPVATMEASRFISEACQQHGFFLVVNHGVDAKLLADAHKYMDNFFLLPLRQKQRAQRKLGEHCGYASSFTGRFSTKLPWKETLSFRYSAENNSSKMVEDYLVNKMGNELRQLGRVYQDYCEAMSKLSLGIMELLAISLGVGRAHFREFFDKNDSIMRLNYYPPCQKPDLTLGTGPHCDPTSLTILHQDRVGGLQVFVDNEWHSISPNFEAFVVNIGDTFMALSNGRYKSCLHQAVVNSHKPRKSLAFFLCPEGDKVVTPPAELVSQNSPRVYPDFTWPMLLEFTQKHYRADMNTLQEFSNWVQQRNS

SEQ ID NO: 488 - protein, 382 aa, Vitis vinifera
  misc_feature (1)..(382): Public GI ID no. 99032729
  misc_feature (225)..(323): Pfam Name: 2OG-FeII_Oxy Pfam Description: 2OG-Fe(II) oxygenase superfamily
  misc_feature (1)..(382): Bit score of 727.5 for HMM based on sequences of Figure 1
  misc_feature (1)..(382): Functional Homolog Of SEQ ID NO. 471
  misc_feature (1)..(382): in Figure 1
MSIVCVEGNPPSMFNPPTDDHKNQEPLVFDASVLRHQSNIPKQFIWPDAEKPGDKATELSVPLIDLGGFLSGDPAAAMEATRLVREACQKHGFFLVVNHGVDDKLIYKAHQYMDSFFGLPLAKKQRAQRKLGEHCGYASSFIGRFSSKLPWKETLSFSYSAEKKSSNAVQEYFLNKMGEDFSEFGQVYQDYCEAMSTLSLVIMELLGMSLGIGGAHFREFFEENDSIMRLNYYPPCLKPDLTLGTGPHCDPTSLTILHQDQVGGLQVFVDDKWWSISPNFDAFVVNIGDTFMALSNGRYKSCLHRAVVNSQTPRKSLAFFLCPEKDKVVRPPTELVDTNSPRIYPDFTWSNLLEFTQKHYRADMKTLEVFSSWLQQKTAEAG

SEQ ID NO: 489 - protein, 379 aa, Nicotiana tabacum
  misc_feature (1)..(379): Public GI ID no. 3327245
  misc_feature (224)..(321): Pfam Name: 2OG-FeII_Oxy Pfam Description: 2OG-Fe(II) oxygenase superfamily
  misc_feature (1)..(379): Bit score of 743.3 for HMM based on sequences of Figure 1
  misc_feature (1)..(379): Functional Homolog Of SEQ ID NO. 471
  misc_feature (1)..(379): in Figure 1
MAIDCMITNVKSPILRILEDEKKPLIFDASQMKREYNIPTQFVWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSISPNFNAFVVNIGDTFMALSNGRYKSCLHRAVVNNKTPRKSLAFFLCPKKDKVVSPPTELVDTNNPRIYPDFTWPTLLEFTQKHYRADMNTLQTFSNWLQQKTAQV

SEQ ID NO: 490 - protein, 385 aa, Populus alba
  misc_feature (1)..(385): Public GI ID no. 34013374
  misc_feature (230)..(328): Pfam Name: 2OG-FeII_Oxy Pfam Description: 2OG-Fe(II) oxygenase superfamily
  misc_feature (1)..(385): Bit score of 734.5 for HMM based on sequences of Figure 1
  misc_feature (1)..(385): Functional Homolog Of SEQ ID NO. 471
  misc_feature (1)..(385): in Figure 1
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 491 - protein, 372 aa, Ipomoea nil
  misc_feature (1)..(372): Public GI ID no. 303303656
  misc_feature (215)..(312): Pfam Name: 2OG-FeII_Oxy Pfam Description: 2OG-Fe(II) oxygenase superfamily
  misc_feature (1)..(372): Bit score of 708.1 for HMM based on sequences of Figure 1
  misc_feature (1)..(372): Functional Homolog Of SEQ ID NO. 471
  misc_feature (1)..(372): in Figure 1
MVNQGGDDVVPKPLIFDASVPQHDPNIPTQFIWPDHEKPAADADAPQLAVPLIDLAGFLSGDPAAALQASRLVGEACKKHGFFLVANHGVDATLISHAHRYMDHFFQLPLSDKQKAERKAGEHCGYASSFTGRFSSKLPWKEILSFSFSADKTSHDIVVDYFQTTLGQDFAHIGKIYQEYCNAMSNLSLGIMELLGMSLGVSEKHFREFYQENESIMRLNYYPPCRKPELTLGTGPHCDPTSLTILHQDTVGGLQVFVDNQWRSIPPNFNAFVVNIGETLMALSNGKYKSCLHRAVVNSKSPRKSLAFFLCPKKDKVVRPPNELVDSSNPRVYPDFTWPTLLEFTQKHYRADMNTLQSFSTWLASTHPNKTI

SEQ ID NO: 492 - protein, 379 aa, Fagus sylvatica
  misc_feature (1)..(379): Public GI ID no. 18496057
  misc_feature (226)..(323): Pfam Name: 2OG-FeII_Oxy Pfam Description: 2OG-Fe(II) oxygenase superfamily
  misc_feature (1)..(379): Bit score of 736.3 for HMM based on sequences of Figure 1
  misc_feature (1)..(379): Functional Homolog Of SEQ ID NO. 471
  misc_feature (1)..(379): in Figure 1
MAIDCITNITSMPHPPKEEHKDHQKQLVFDASVLRHQTNIPQQFIWPDEEKPRANAPELQVPLIDLRGFLSGDPTAANEASSLVGKACQKHGFFLVVNHGVDDKLIAHAHQYIDYFFELPMSAKQRAQRKVGEHCGYASSFTGRFSFKLPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAVVNSKTPRKSLAFFLCPKNDKVVSPPSELVDSLCPRVYPDFTWPMLLEFTQKHYRADVKTLEVFSNWLQQKNS

SEQ ID NO: 493 - protein, 389 aa, Ricinus communis
  misc_feature (1)..(389): Public GI ID no. 255541396
  misc_feature (235)..(333): Pfam Name: 2OG-FeII_Oxy Pfam Description: 2OG-Fe(II) oxygenase superfamily
  misc_feature (1)..(389): Bit score of 716 for HMM based on sequences of Figure 1
  misc_feature (1)..(389): Functional Homolog Of SEQ ID NO. 471
  misc_feature (1)..(389): in Figure 1
MPVTVDQSDSNMALSPPPAPPPHLTLPPKFQEPQQTLVFDASILQHQSNIPSQFVWPDHEKPCLDSPQLAIPPIDLGSFLSGDHLAVSKAVELVNEACKKHGFFLVVNHGVDSRLIAKAHEYMEMFFSMPMMVKQRAQRRIGDHCGYASSFTGRFSSKLPWKETLSFRYCDDNNFSNIVQEYFSNVMGEEFRQFGKVYQEYCEAMSTLSLRIMELLGLTLGVGRAYFREFFEGNDSIMRLNYYPPCQKPDLTLGTGPHCDPTSLTILHQDEVGGLQVFVDEKWHSVHPDPQAFVVNIGDTFMALSNGIFKSCLHRAVVNNRTVRKSLAFFLCPNMEKVVKPPKNLVDSNNPRIYPDFTWPALLEFTQKYYRADMKTLDVFANWLQQKKS

SEQ ID NO: 494 - DNA, 1261 bp, Arabidopsis thaliana
  misc_feature (1)..(1261): Ceres Annot ID no. 878887
  misc_feature (1)..(1261): Encodes the peptide sequence at SEQ ID NO. 495
aatactactactcactttactataatctctcaaaatggccgtaagtttcgtaacaacatctcctgaggaagaagacaaaccgaagctaggccttggaaatattcaaactccgttaatcttcaacccttcaatgcttaaccttcaagccaatatcccaaaccaattcatctggcctgacgacgaaaaaccttccatcaacgttctcgagcttgatgttcctctcatcgaccttcaaaaccttctctctgatccatcctccactttagatgcttcgagactgatctctgaggcctgtaagaagcacggtttcttcctcgtggtcaatcacggcatcagcgaggagcttatttcagacgctcatgaatacacgagccgcttctttgatatgcctctctccgaaaaacagagggttcttagaaaatccggtgagagtgttggctacgcaagcagtttcaccggacgcttctccaccaagcttccatggaaggagaccctttctttccggttttgcgacgacatgagccgctcaaaatccgttcaagattacttctgcgatgcgttgggacatgggtttcagccatttgggaaggtgtatcaagagtattgtgaagcaatgagttctctatcactgaagatcatggagcttctggggctaagtttaggcgtaaaacgggactactttagagagtttttcgaagaaaacgattcaataatgagactgaattactaccctccatgtataaaaccagatctcacactaggaacaggacctcattgtgatccaacatctcttaccatccttcaccaagaccatgttaatggccttcaagtctttgtggaaaatcaatggcgctccattcgtcccaaccccaaggcctttgtggtcaatatcggcgatactttcatggctctatcgaacgatagatacaagagctgcttgcaccgggcggtggtgaacagcgagagcgagaggaaatcacttgcattcttcttgtgtccgaaaaaagacagagtagtgacgccaccgagagagcttttggacagcatcacatcaagaagataccctgacttcacatggtctatgttccttgagttcactcagaaacattatagagcagacatgaacactctccaagccttttcagattggctcaccaaacccatctaagaaataaaatattcatgtcttgtcttgttagttactagtatcttctttatatttcatgtatgtatatggtaataggcaataacaccttttagc

SEQ ID NO: 495 - protein, 377 aa, Arabidopsis thaliana
  misc_feature (1)..(377): Ceres Annot ID no. 878887
  misc_feature (224)..(322): Pfam Name: 2OG-FeII_Oxy Pfam Description: 2OG-Fe(II) oxygenase superfamily
  misc_feature (1)..(377): Bit score of 677.2 for HMM based on sequences of Figure 1
  misc_feature (1)..(377): Functional Homolog Of SEQ ID NO. 471
  misc_feature (1)..(377): in Figure 1
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 496 - protein, 398 aa, Oryza officinalis
  misc_feature (1)..(398): Public GI ID no. 210142296
  misc_feature (232)..(329): Pfam Name: 2OG-FeII_Oxy Pfam Description: 2OG-Fe(II) oxygenase superfamily
  misc_feature (1)..(398): Bit score of 488.6 for HMM based on sequences of Figure 1
  misc_feature (1)..(398): Functional Homolog Of SEQ ID NO. 471
MVAEPPTPPQHQPTSAVTPPMDSTGSGIAAPGATAAAVCDLRLEPKIPEPFVWPNADARPASAAELDMPVVDVGVLRNGDAEGLRRAAEQVAAACATHGFFQVSGHSVDAALARAALDGASDFFRLPLAEKRRARRVPGTVSGYTSAHADRFASKLPWKETLSFGFHDRGAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGDWRPVSPVPGAMVINIGDTFMALSNGRYRSCLHRAVVNRRQERRSLAFFLCPREDRVVRPPPSAATPRQYPDFTWADLMRFTQRHYRADTRTLDAFTRWLAPPPDAAAAAAAATAQVEAAS

SEQ ID NO: 497 - DNA, 1164 bp, Sorghum bicolor
  misc_feature (1)..(1164): Ceres Annot ID no. 8669917
  misc_feature (1)..(1164): Encodes the peptide sequence at SEQ ID NO. 498
atggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctag

SEQ ID NO: 498 - protein, 387 aa, Sorghum bicolor
  misc_feature (1)..(387): Ceres Annot ID no. 8669917
  misc_feature (227)..(324): Pfam Name: 2OG-FeII_Oxy Pfam Description: 2OG-Fe(II) oxygenase superfamily
  misc_feature (1)..(387): Bit score of 507.0 for HMM based on sequences of Figure 1
  misc_feature (1)..(387): Functional Homolog Of SEQ ID NO. 471
MDASSPAPPLLLRAPTPSPSIDLPAAAGKAAAVFDLRREPKIPAPFLWPHEEARPTSAAELEVPVVDVGVLRNGDRAGLRRAAAQVASACATHGFFQVCGHGVDAALGRAALDGASDFFRLPLADKQRARRVPGTVSGYTSAHADRFASKLPWKETLSFGFHDGAASPVVVDYFTGTLGQDFEPMGRVYQRYCEKMKELSLTIMELLELSLGVERGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRQERRSLAFFLCPREDRVVRPPASSATPRQYPDFTWADLMRFTQRHYRADTRTLDAFTRWLSHGPVPAQEAAAPCT

SEQ ID NO: 499 - protein, 378 aa, Arabidopsis thaliana
  misc_feature (1)..(378): Public GI ID no. 15242189
  misc_feature (222)..(320): Pfam Name: 2OG-FeII_Oxy Pfam Description: 2OG-Fe(II) oxygenase superfamily
  misc_feature (1)..(378): Bit score of 643.5 for HMM based on sequences of Figure 1
  misc_feature (1)..(378): Functional Homolog Of SEQ ID NO. 471
MAILCTTTSPAEKEHEPKQDLEKDQTSPLIFNPSLLNLQSQIPNQFIWPDEEKPSIDIPELNVPFIDLSSQDSTLEAPRVIAEACTKHGFFLVVNHGVSESLIADAHRLMESFFDMPLAGKQKAQRKPGESCGYASSFTGRFSTKLPWKETLSFQFSNDNSGSRTVQDYFSDTLGQEFEQFGKVYQDYCEAMSSLSLKIMELLGLSLGVNRDYFRGFFEENDSIMRLNHYPPCQTPDLTLGTGPHCDPSSLTILHQDHVNGLQVFVDNQWQSIRPNPKAFVVNIGDTFMALSNGIFKSCLHRAVVNRESARKSMAFFLCPKKDKVVKPPSDILEKMKTRKYPDFTWSMFLEFTQKHYRADVNTLDSFSNWVITNNNPI

SEQ ID NO: 500 - protein, 359 aa, Dasypyrum villosum
  misc_feature (1)..(359): Public GI ID no. 255927093
  misc_feature (201)..(299): Pfam Name: 2OG-FeII_Oxy Pfam Description: 2OG-Fe(II) oxygenase superfamily
  misc_feature (1)..(359): Bit score of 694.7 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 501 - protein, 363 aa, Lolium perenne
  misc_feature (1)..(363): Public GI ID no. 67462129
  misc_feature (202)..(299): Pfam Name: 2OG-FeII_Oxy Pfam Description: 2OG-Fe(II) oxygenase superfamily
  misc_feature (1)..(363): Bit score of 697.3 for HMM based on sequences of Figure 1
  misc_feature (1)..(363): Functional Homolog Of SEQ ID NO. 471
MVQPVFDAALLSGQSDIPSQFIWPADESPTPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 502 - protein, 378 aa, Solanum tuberosum
  misc_feature (1)..(378): Public GI ID no. 10800974
  misc_feature (1)..(378): Solanum tuberosum subsp. andigenum
  misc_feature (219)..(317): Pfam Name: 2OG-FeII_Oxy Pfam Description: 2OG-Fe(II) oxygenase superfamily
  misc_feature (1)..(378): Bit score of 713.3 for HMM based on sequences of Figure 1
  misc_feature (1)..(378): Functional Homolog Of SEQ ID NO. 471
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 503 - protein, 380 aa, Pisum sativum
  misc_feature (1)..(380): Public GI ID no. 6855711
  misc_feature (227)..(324): Pfam Name: 2OG-FeII_Oxy Pfam Description: 2OG-Fe(II) oxygenase superfamily
  misc_feature (1)..(380): Bit score of 707.9 for HMM based on sequences of Figure 1
  misc_feature (1)..(380): Functional Homolog Of SEQ ID NO. 471
MAIECITSSAKLMTQKSDKNENEGSSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 504 - protein, 417 aa, Zea mays
  misc_feature (1)..(417): Public GI ID no. 223943497
  misc_feature (260)..(357): Pfam Name: 2OG-FeII_Oxy Pfam Description: 2OG-Fe(II) oxygenase superfamily
  misc_feature (1)..(417): Bit score of 497.9 for HMM based on sequences of Figure 1
  misc_feature (1)..(417): Functional Homolog Of SEQ ID NO. 471
MVSQERQEPAVPSSSSSSAKRAATSMDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGYHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRRARRSLAFFLCPREDRVVRPPASAAPRRYPDFTWADLMRFTQRHYRADTRTLDAFTRWLSHGPAQAAAPPCT

SEQ ID NO: 505 - protein, 398 aa, Oryza brachyantha
  misc_feature (1)..(398): Public GI ID no. 210142300
  misc_feature (234)..(331): Pfam Name: 2OG-FeII_Oxy Pfam Description: 2OG-Fe(II) oxygenase superfamily
  misc_feature (1)..(398): Bit score of 492.7 for HMM based on sequences of Figure 1
  misc_feature (1)..(398): Functional Homolog Of SEQ ID NO. 471
MVAKPAPPHQPSSHPTHRPAPPAVPMDATGIDVGAGGGAVCDLRKEPKIPEPFVWPNGDARPASAGELDMPVVDVGVLRNGDAAGLRRAAAQVAAACATHGFFQVSGHGVDAALARAALDGASEFFRLPLAEKRRARRVPGTVSGYTSAHADRFASKLPWKETLSFGFHDRGDTPVVADYFSSTLGPDFEPMGRVYQKYCEEMKELSLTIMELLELSLGVERGYYREFFADSSSIMRCNYYPPCPEPERTLGTGPHCDPTALTILLQDDVGGLEVLVDGDWRPVSPVPGAMVINIGDTFMALSNGRYKSCLHRAVVNRRQERRSLAFFLCPREDRVVRPPPSAATPRHYPDFTWADLMRFTQRHYRADTRTLDAFTRWLAPPPPDAAAAVTPQLEAAS

SEQ ID NO: 506 - protein, 359 aa, Dasypyrum villosum
  misc_feature (1)..(359): Public GI ID no. 255927115
  misc_feature (201)..(299): Pfam Name: 2OG-FeII_Oxy Pfam Description: 2OG-Fe(II) oxygenase superfamily
  misc_feature (1)..(359): Bit score of 697.5 for HMM based on sequences of Figure 1
  misc_feature (1)..(359): Functional Homolog Of SEQ ID NO. 471
MVQPVFDSAVLSGRADIPSQFIWPEGESPTPDAAEELHVPLIDIGGMLSGDPRAAAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWWSLLDFTQKHYRADMKTLEVFSSWVVQQQQAAMT

SEQ ID NO: 507 - DNA, 1101 bp, Populus trichocarpa
  misc_feature (1)..(1101): Ceres Annot ID no. 1497117
  misc_feature (1)..(1101): Encodes the peptide sequence at SEQ ID NO. 508
atggtaatgcctcctactcttcctcctcctcgacagccattagtatttgatgcttcaattcttcaacaccaagccaatataccctctcagttcatttggcctgaccacgaaaaaccatgccttgaatccccaaaacttgcaatcccccctattgattttggaagcttcctcactggagatcctttggcagtctcaaaagctactcagctagtaaatgaggcatgcaagaagcatggattctttctagttgttaaccatggagttgattcaaagcttatagctaaagctcatgagtatatgaacatgttttttggcatacaactctcagagaagcaaagagctcaaagaaagataggagagcaatatgggtatgctagtagcttcactggaagattctcctccaaacttccatggaaagaaacactttctttccgatattgtgctgacaatcagtcttctgacatcgtccaagaatacttcttgaatgtaatgggagaaaatttcaaacaattcgggaaggtttaccaagaatattgtgaagccatgaacactctttctcttggaattatggagctattaggagtaagtctaggagttggaagagaatattttagagatttcttcgaaggaaacgattcgataatgagactgaattactaccctccttgccaaaagccggatttaactcttggcactgggcctcattgtgatcccacatccttaacaatcctccatcaagatcatgtcggtggccttcaagtgttcgtcgatgaaaaatggcactccgtcagtcctgatccggaagctttcgtcgtcaacatcggtgacacattcacggctctatcaaatggcattttcaagagttgcttgcatagagcggtggtaaataatgtaacagtaaggaaatcccttgctttctttctctgtccaaaactggataaggtggtgaagccaccaaataccttgatcgactctaagaatccgagggtatatccggacttcacatggccaactttgtcagaattcacacagaaacattatagggccgacatgaaaaccctagatgtcttcacaacctggcttcaacaaaaaaacaattag

SEQ ID NO: 508 - protein, 366 aa, Populus trichocarpa
  misc_feature (1)..(366): Ceres Annot ID no. 1497117
  misc_feature (1)..(366): Public GI ID no. 224063947
  misc_feature (212)..(310): Pfam Name: 2OG-FeII_Oxy Pfam Description: 2OG-Fe(II) oxygenase superfamily
  misc_feature (1)..(366): Bit score of 687.9 for HMM based on sequences of Figure 1
  misc_feature (1)..(366): Functional Homolog Of SEQ ID NO. 471
MVMPPTLPPPRQPLVFDASILQHQANIPSQFIWPDHEKPCLESPKLAIPPIDFGSFLTGDPLAVSKATQLVNEACKKHGFFLVVNHGVDSKLIAKAHEYMNMFFGIQLSEKQRAQRKIGEQYGYASSFTGRFSSKLPWKETLSFRYCADNQSSDIVQEYFLNVMGENFKQFGKVYQEYCEAMNTLSLGIMELLGVSLGVGREYFRDFFEGNDSIMRLNYYPPCQKPDLTLGTGPHCDPTSLTILHQDHVGGLQVFVDEKWHSVSPDPEAFVVNIGDTFTALSNGIFKSCLHRAVVNNVTVRKSLAFFLCPKLDKVVKPPNTLIDSKNPRVYPDFTWPTLSEFTQKHYRADMKTLDVFTTWLQQKNN

SEQ ID NO: 509 - protein, 359 aa, Dasypyrum villosum
  misc_feature (1)..(359): Public GI ID no. 255927101
  misc_feature (201)..(299): Pfam Name: 2OG-FeII_Oxy Pfam Description: 2OG-Fe(II) oxygenase superfamily
  misc_feature (1)..(359): Bit score of 691.6 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFVALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 510 - protein, 389 aa, Oryza sativa
  misc_feature (1)..(389): Public GI ID no. 335056045
  misc_feature (1)..(389): Oryza sativa Indica Group
  misc_feature (227)..(324): Pfam Name: 2OG-FeII_Oxy Pfam Description: 2OG-Fe(II) oxygenase superfamily
  misc_feature (1)..(389): Bit score of 476.8 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRGGVNQRRERRSLAFFLCPREDRGVRPPPSAPPPRHYPDFTWADLMRFTQRHYRANTRTLDAFTRWLAPPAADAAATAQVEAAS

SEQ ID NO: 511 - protein, 195 aa, Oryza sativa
  misc_feature (1)..(195): Public GI ID no. 125546514
  misc_feature (1)..(195): Oryza sativa Indica Group
  misc_feature (34)..(132): Pfam Name: 2OG-FeII_Oxy Pfam Description: 2OG-Fe(II) oxygenase superfamily
  misc_feature (1)..(195): Bit score of 374.6 for HMM based on sequences of Figure 1
  misc_feature (1)..(195): Functional Homolog Of SEQ ID NO. 471
MSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLGFFLCPEMDTVVRPPEELVDDHHPRVYPDFTWRALLDFTQRHYRADMRTLQAFSDWLNHHRHLQPTIYS

SEQ ID NO: 512 - protein, 268 aa, Oryza sativa
  misc_feature (1)..(268): Public GI ID no. 208609486
  misc_feature (1)..(268): Oryza sativa Indica Group
  misc_feature (227)..(268): Pfam Name: 2OG-FeII_Oxy Pfam Description: 2OG-Fe(II) oxygenase superfamily
  misc_feature (1)..(268): Bit score of 302.4 for HMM based on sequences of Figure 1
  misc_feature (1)..(268): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEV

SEQ ID NO: 513 - protein, 379 aa, Nicotiana sylvestris
  misc_feature (1)..(379): Public GI ID no. 20149239
  misc_feature (224)..(321): Pfam Name: 2OG-FeII_Oxy Pfam Description: 2OG-Fe(II) oxygenase superfamily
  misc_feature (1)..(379): Bit score of 734.9 for HMM based on sequences of Figure 1
  misc_feature (1)..(379): Functional Homolog Of SEQ ID NO. 471
MTIDCMITNVKSPMLRILEDEKRPLIFDASQMKREYNIPTQFIWPDDEKPRATARELPVPLIDLGGFLSGDPVAAQQASRLVGEACRNHGFFLVVNHGVNANLICNAHRFMDMFFDLPLSEKQKAQRKLGEHCGYASSFTGRFSSKLPWKETLSFRYSAQEDSSRIVKEYFQNTMGESFSHLGNVYQEYCNSMSILSLGIMELLGMSLGVGREHFKEFFEENESIMRLNYYPPCQKPDLTLGTGPHCDPTSLTILHQDCVGGLQVFVDNEWRSISPNFNAFVVNIGDTFMALSNGRYKSCLHRAVVNNKTPRKSLAFFLCPKKDKVVSPPTELVDSNNPRIYPNFTWPTLLEFTQKHYRADMNTLQSFSNWLQQTTAQV

SEQ ID NO: 514 - protein, 369 aa, Zoysia japonica
  misc_feature (1)..(369): Public GI ID no. 109452794
  misc_feature (196)..(293): Pfam Name: 2OG-FeII_Oxy Pfam Description: 2OG-Fe(II) oxygenase superfamily
  misc_feature (1)..(369): Bit score of 542.1 for HMM based on sequences of Figure 1
  misc_feature (1)..(369): Functional Homolog Of SEQ ID NO. 471
MAAASTPNGDPPVRSLATTVPVQAVLFDIDGTLCDSDPLHHVAFQELLLEIGYNNGVPIGHGFFQVVNHGIDQEPLAEAHRCMDNFFTLPLPEKQRAQRRQGESCGYASSFTGRFACKLPWKETLSFRYSSNPSSPDLVVDYFVEKLGEDYRHHGAVYARYCSEMSRLSLEMMGILGESLGVGRDHFRRFFQPNESIMRLNYYPPCQRPLETLGTGPHCDPTSLTILHQDHVGGLQVFTDGRWRSIRPHAGAFVVNIGDTFTGALQRPVPKLLHRAVVNSLVPRKSLAFFLCPEMDKVVCPPEGLVEAGMPRAYPDFTWRTLLDFTQRRYRADMRTLEVFSNWLRHGQDKTPPTSLIHRSKIVTVHHPS

SEQ ID NO: 515 - protein, 359 aa, Dasypyrum villosum
  misc_feature (1)..(359): Public GI ID no. 255927111
  misc_feature (201)..(299): Pfam Name: 2OG-FeII_Oxy Pfam Description: 2OG-Fe(II) oxygenase superfamily
  misc_feature (1)..(359): Bit score of 697.3 for HMM based on sequences of Figure 1
  misc_feature (1)..(359): Functional Homolog Of SEQ ID NO. 471
MVQPVFDSAVLSGRADIPSQFIWPEGESPTPDAAEELHVPLIDIGGMLSGDPRAAAEVTRLVGGACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 516 - DNA, 1499 bp, Arabidopsis thaliana
  misc_feature (1)..(1499): Ceres Annot ID no. 881675
  misc_feature (1)..(1499): Encodes the peptide sequence at SEQ ID NO. 517
accgaccactgtactgaatctttaagcctctcaacgtgttttttatatatattttgaaaatcttttacgccttaaaaggatctacgataattaaaaaaaaatggcaacggaatgcattgcaacggtccctcaaatattcagtgaaaacaaaaccaaagaggattcttcgatcttcgatgcaaagctccttaatcagcactcgcaccacatacctcaacagttcgtatggcccgaccacgagaaaccttctacggatgttcaacctctccaagtcccactcatagacctagccggtttcctctccggcgactcgtgcttggcatcggaggctactagactcgtctcaaaggctgcaacgaaacatggcttcttcctaatcactaaccatggtgtcgatgagagcctcttgtctcgtgcctatctgcatatggactctttctttaaggccccggcttgtgagaagcagaaggctcagaggaagtggggtgagagctccggttacgctagtagtttcgtcgggagattctcctcaaagctcccgtggaaggagactctgtcgtttaagttctctcccgaggagaagatccattcccaaaccgttaaagactttgtttctaagaaaatgggcgatggatacgaagatttcgggaaggtttatcaagaatacgcggaggccatgaacactctctcactaaagatcatggagcttcttggaatgagtcttggggtcgagaggagatattttaaagagtttttcgaagacagcgattcaatattccggttgaattactacccgcagtgcaagcaaccggagcttgcactagggacaggaccccactgcgacccaacatctctaaccatacttcatcaagaccaagttggcggtctgcaagttttcgtggacaacaaatggcaatccattcctcctaaccctcacgctttcgtggtgaacataggcgacaccttcatggctctaacgaatggaagatacaagagttgtttgcatcgggcggtggtgaacagcgagagagaaaggaagacgtttgcattcttcctatgtccgaaaggggaaaaagtggtgaagccaccagaagaactagtaaacggagtgaagtctggtgaaagaaagtatcctgattttacgtggtctatgtttcttgagttcacacagaagcattatagggcagacatgaacactcttgacgagttctcaatttggcttaagaacagaagaagtttctaaaattgaggagacaatgttgtggtccagaaggtcacttgtagttatgtatagagctttcactgtttttcttaagatgttcaagacttgttaaggatcggagacttttttgttcttttattatcttgctctaggttgtctggtgttaaataaaagtagcaaaaaaataaaaatatatgtactccattgggtctacttatgatttgtttcgaaatggtttttttatagtctctaatgttaaatttatgtcactattact

SEQ ID NO: 517 - protein, 380 aa, Arabidopsis thaliana
  misc_feature (1)..(380): Ceres Annot ID no. 881675
  misc_feature (1)..(380): Public GI ID no. 15240722
  misc_feature (223)..(321): Pfam Name: 2OG-FeII_Oxy Pfam Description: 2OG-Fe(II) oxygenase superfamily
  misc_feature (1)..(380): Bit score of 618.4 for HMM based on sequences of Figure 1
  misc_feature (1)..(380): Functional Homolog Of SEQ ID NO. 471
MATECIATVPQIFSENKTKEDSSIFDAKLLNQHSHHIPQQFVWPDHEKPSTDVQPLQVPLIDLAGFLSGDSCLASEATRLVSKAATKHGFFLITNHGVDESLLSRAYLHMDSFFKAPACEKQKAQRKWGESSGYASSFVGRFSSKLPWKETLSFKFSPEEKIHSQTVKDFVSKKMGDGYEDFGKVYQEYAEAMNTLSLKIMELLGMSLGVERRYFKEFFEDSDSIFRLNYYPQCKQPELALGTGPHCDPTSLTILHQDQVGGLQVFVDNKWQSIPPNPHAFVVNIGDTFMALTNGRYKSCLHRAVVNSERERKTFAFFLCPKGEKVVKPPEELVNGVKSGERKYPDFTWSMFLEFTQKHYRADMNTLDEFSIWLKNRRSF

SEQ ID NO: 518 - protein, 377 aa, Arabidopsis thaliana
  misc_feature (1)..(377): Public GI ID no. 9791186
  misc_feature (224)..(322): Pfam Name: 2OG-FeII_Oxy Pfam Description: 2OG-Fe(II) oxygenase superfamily
  misc_feature (1)..(377): Bit score of 678.4 for HMM based on sequences of Figure 1
  misc_feature (1)..(377): Functional Homolog Of SEQ ID NO. 471
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCMKPDLTLGTGPHCDPTSLTILHQDHVNGLQVFVENQWRSIRPNPKAFVVNIGDTFMALSNDRYKSCLHRAVVNSKSERKSLAFFLCPKKDRVVTPPRELLDSITSRRYPDFTWSMFLEFTQKHYRADMNTLQAFSDWLTKPI

SEQ ID NO: 519 - protein, 359 aa, Dasypyrum villosum
  misc_feature (1)..(359): Public GI ID no. 255927119
  misc_feature (201)..(299): Pfam Name: 2OG-FeII_Oxy Pfam Description: 2OG-Fe(II) oxygenase superfamily
  misc_feature (1)..(359): Bit score of 699.5 for HMM based on sequences of Figure 1
  misc_feature (1)..(359): Functional Homolog Of SEQ ID NO. 471
MVQPVFDSAVLSGRADIPSQFIWPEGESPTPDAAEELHVPLIDIGGMLSGDPRAAAEVTRLVGEACEQHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 520 - protein, 359 aa, Dasypyrum villosum
  misc_feature (1)..(359): Public GI ID no. 255927105
  misc_feature (201)..(299): Pfam Name: 2OG-FeII_Oxy Pfam Description: 2OG-Fe(II) oxygenase superfamily
  misc_feature (1)..(359): Bit score of 691.6 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGLFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 521 - protein, 370 aa, Oryza sativa
  misc_feature (1)..(370): Public GI ID no. 30102973
  misc_feature (1)..(370): Oryza sativa Japonica Group
  misc_feature (209)..(307): Pfam Name: 2OG-FeII_Oxy Pfam Description: 2OG-Fe(II) oxygenase superfamily
  misc_feature (1)..(370): Bit score of 652.5 for HMM based on sequences of Figure 1
  misc_feature (1)..(370): Functional Homolog Of SEQ ID NO. 471
MVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 522 - protein, 371 aa, Oryza sativa
  misc_feature (1)..(371): Public GI ID no. 1854637
  misc_feature (210)..(308): Pfam Name: 2OG-FeII_Oxy Pfam Description: 2OG-Fe(II) oxygenase superfamily
  misc_feature (1)..(371): Bit score of 623.4 for HMM based on sequences of Figure 1
  misc_feature (1)..(371): Functional Homolog Of SEQ ID NO. 471
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRRSGARGRTAYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTFQAFSDWLNHHRHLQPTIYS

SEQ ID NO: 523 - protein, 391 aa, Oryza punctata
  misc_feature (1)..(391): Public GI ID no. 210142292
  misc_feature (229)..(326): Pfam Name: 2OG-FeII_Oxy Pfam Description: 2OG-Fe(II) oxygenase superfamily
  misc_feature (1)..(391): Bit score of 493.2 for HMM based on sequences of Figure 1
  misc_feature (1)..(391): Functional Homolog Of SEQ ID NO. 471
MVGEPPTPPQHQPSPAATPPMDSTGSGIAAPAAAVCDLRLEPKIPEPFVWPNADARPASAAELDMPVVDVGVLRNGDAEGLRRAAAQVAAACATHGFFQVSGHGVDAALARAALDGASDFFRLPLAEKRRARRVPGTVSGYTSAHADRFASKLPWKETLSFGFHDRAASPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGDWRPVSPVPGAMVINIGDTFMALSNGRYKSCLHRAVVNRRQERRSLAFFLCPREDRVVRPPPSAATPRQYPDFTWADLMRFTQRHYRADTRTLDAFTRWLAPPADAAAATAQVEAAS

SEQ ID NO: 524 - protein, 268 aa, Oryza glumipatula
  misc_feature (1)..(268): Public GI ID no. 82568041
  misc_feature (227)..(268): Pfam Name: 2OG-FeII_Oxy Pfam Description: 2OG-Fe(II) oxygenase superfamily
  misc_feature (1)..(268): Bit score of 302.0 for HMM based on sequences of Figure 1
  misc_feature (1)..(268): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVATACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEV

SEQ ID NO: 525 - protein, 377 aa, Arabidopsis lyrata
  misc_feature (1)..(377): Public GI ID no. 297795983
  misc_feature (1)..(377): Arabidopsis lyrata subsp. lyrata
  misc_feature (221)..(319): Pfam Name: 2OG-FeII_Oxy Pfam Description: 2OG-Fe(II) oxygenase superfamily
  misc_feature (1)..(377): Bit score of 639.0 for HMM based on sequences of Figure 1
  misc_feature (1)..(377): Functional Homolog Of SEQ ID NO. 471
MAILCTTTSPAEKEHEPKQDLEKDQTPLIFNPSLLNLQSQIPNQFIWPDEEKPSIDIPELNVPFIDLSSQDSTLEAPRVIAEACTKHGFFLVVNHGVSESLISDAQRLMERFFDMPLAGKQKAQRKPGESCGYASSFTGRFSTKLPWKETLSFQFSNENSGSRTVQDYFSDTLGQEFEQVGKVYQDYCEAMSSLSLKIMELMGLSLGVNRDYFRGFFQENDSIMRLNHYPPCQTPELTLGTGPHCDPSSLTILHQDHVNGLQVFVDNQWQSIRPNPKAFVVNIGDTFMALSNGIFKSCLHRAVVNRESARKSMAFFLCPKKDKVVKPPSDILEKMTTRKYPDFTWSMFLEFTQKHYRADVNTLDSFSNWVITNKNPI

SEQ ID NO: 526 - protein, 359 aa, Dasypyrum villosum
  misc_feature (1)..(359): Public GI ID no. 255927103
  misc_feature (201)..(299): Pfam Name: 2OG-FeII_Oxy Pfam Description: 2OG-Fe(II) oxygenase superfamily
  misc_feature (1)..(359): Bit score of 685.8 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDASFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFDVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 527 - protein, 377 aa, Arabidopsis thaliana
  misc_feature (1)..(377): Public GI ID no. 62320340
  misc_feature (224)..(322): Pfam Name: 2OG-FeII_Oxy Pfam Description: 2OG-Fe(II) oxygenase superfamily
  misc_feature (1)..(377): Bit score of 674.5 for HMM based on sequences of Figure 1
  misc_feature (1)..(377): Functional Homolog Of SEQ ID NO. 471
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFGENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 528 - protein, 370 aa, Oryza sativa
  misc_feature (1)..(370): Public GI ID no. 125546516
  misc_feature (1)..(370): Oryza sativa Indica Group
  misc_feature (209)..(307): Pfam Name: 2OG-FeII_Oxy Pfam Description: 2OG-Fe(II) oxygenase superfamily
  misc_feature (1)..(370): Bit score of 653.5 for HMM based on sequences of Figure 1
  misc_feature (1)..(370): Functional Homolog Of SEQ ID NO. 471
MVVQQEQEVVFDAAVLSGQTEIPSQFIWPAEESPGSVAAEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 529 - protein, 373 aa, Fragaria x ananassa
  misc_feature (1)..(373): Public GI ID no. 77632796
  misc_feature (218)..(316): Pfam Name: 2OG-FeII_Oxy Pfam Description: 2OG-Fe(II) oxygenase superfamily
  misc_feature (1)..(373): Bit score of 707.7 for HMM based on sequences of Figure 1
  misc_feature (1)..(373): Functional Homolog Of SEQ ID NO. 471
MAVGCMKTLSHHKEDDQKPLVFDASLLRYETDIPKQFIWPDDEKPCPNTRELQVPLIDLGDFLSGNPEAAMKASRLVGEACEKHGFFLVVNHRVKESLIADAHQYMDEFFGLPLSEKQRTQRKAGEHCGYASSFTGRFSSKLPWKETLSFSYTADQSSSNVVKDYLCNAMGEEFDEFGRVYQDYSEAMSTLSIGIMELLGMSLGVGRTHFKEFFGDNDSIMRLNYYPPCQKPDQTLGTGPHCDPTSLTILHQDQVGGPEVFVDEEWRSISPNLNAFVVNIGDAFMALSNGRYKSCLHRAVVNSKTPRKSLAFFLCPKDDKVVKPPRELIDSSYPRIYPDFTWPMLLEFTQKHYRADMKTLQAFTNWLQEQRSS

SEQ ID NO: 530 - protein, 347 aa, Oryza sativa
  misc_feature (1)..(347): Public GI ID no. 125528619
  misc_feature (1)..(347): Oryza sativa Indica Group
  misc_feature (211)..(308): Pfam Name: 2OG-FeII_Oxy Pfam Description: 2OG-Fe(II) oxygenase superfamily
  misc_feature (1)..(347): Bit score of 422.4 for HMM based on sequences of Figure 1
  misc_feature (1)..(347): Functional Homolog Of SEQ ID NO. 471
MDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVRHYRADTRTLDAFTRWLAPPAADAAATAQVEAAS

SEQ ID NO: 531 - protein, 389 aa, Oryza sativa
  misc_feature (1)..(389): Public GI ID no. 335056055
  misc_feature (1)..(389): Oryza sativa Indica Group
  misc_feature (227)..(324): Pfam Name: 2OG-FeII_Oxy Pfam Description: 2OG-Fe(II) oxygenase superfamily
  misc_feature (1)..(389): Bit score of 476.9 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRGGVNQRRERRSLAFFLCPREDRGVRPPPSAPPPRHYPDFTWADLMRFTQRHYRANTRTLDAFTRWLAPPAANAAATAQVEAAS

SEQ ID NO: 532 - protein, 359 aa, Dasypyrum villosum
  misc_feature (1)..(359): Public GI ID no. 255927121
  misc_feature (201)..(299): Pfam Name: 2OG-FeII_Oxy Pfam Description: 2OG-Fe(II) oxygenase superfamily
  misc_feature (1)..(359): Bit score of 697.1 for HMM based on sequences of Figure 1
  misc_feature (1)..(359): Functional Homolog Of SEQ ID NO. 471
MVQPVFDSAVLSGRADIPSQFIWPGGESPTPDAAEELHVPLIDIGGMISGDPRAAAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 533 - protein, 389 aa, Oryza glumipatula
  misc_feature (1)..(389): Public GI ID no. 210142286
  misc_feature (227)..(324): Pfam Name: 2OG-FeII_Oxy Pfam Description: 2OG-Fe(II) oxygenase superfamily
  misc_feature (1)..(389): Bit score of 493.5 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVATACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 534 - protein, 367 aa, Vitis vinifera
  misc_feature (1)..(367): Public GI ID no. 147782450
  misc_feature (213)..(311): Pfam Name: 2OG-FeII_Oxy Pfam Description: 2OG-Fe(II) oxygenase superfamily
  misc_feature (1)..(367): Bit score of 700.6 for HMM based on sequences of Figure 1
  misc_feature (1)..(367): Functional Homolog Of SEQ ID NO. 471
MELPLDEANTQHQSLVFDASVLKYQSTIPSQFIWPDEEKPCAKPPELLVPPIDLGGFLSADPLAISNAARLVNEACRKHGFFLVVNHGVDAQLVTEAHKNMDFFFNMSLSEKQRAQRKVGDHCGYASSFTGRFSTKLPWKETLSFRYCDDDQSSRIIEKYFSNVMGEDFKQFGRVYQQYCEAMSRLSLGIMELLGMSLGVGREYFREFFEGNDSIMRLNYYPPCQKPNLTLGTGPHCDPTSLTILHQDQVSGLQVFVDEKWHSISPNSEAFVVNIGDTFMALSNGIYKSCLHRAVVNSQTPRKSLAFFLCPKMEKVVSPPNGLADANNPRIYPDFTWSSLLEFTQKHYRADTKTLHVFSNWLQQKNN

SEQ ID NO: 535 - protein, 280 aa, Zea mays
  misc_feature (1)..(280): Public GI ID no. 226492950
  misc_feature (235)..(270): Pfam Name: 2OG-FeII_Oxy Pfam Description: 2OG-Fe(II) oxygenase superfamily
  misc_feature (1)..(280): Bit score of 285.2 for HMM based on sequences of Figure 1
  misc_feature (1)..(280): Functional Homolog Of SEQ ID NO. 471
  misc_feature (147)..(147): Xaa is any aa, unknown, or other
  misc_feature (160)..(160): Xaa is any aa, unknown, or other
  misc_feature (174)..(174): Xaa is any aa, unknown, or other
MDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYXSAHADRFAAKLPXKETLSFGYHDGAAXPVVVDYFVGTLGQDFEPMGWVYQRYCEEMKELSLTIMELLELSLGVELRGYYREFFEDSRSIMRCNYYPPCPEPERTLGTGPHCDPTALTILLQDVRGRAGGAGGR

SEQ ID NO: 536 - protein, 378 aa, Oryza sativa
  misc_feature (1)..(378): Public GI ID no. 218196824
  misc_feature (1)..(378): Oryza sativa Indica Group
  misc_feature (206)..(304): Pfam Name: 2OG-FeII_Oxy Pfam Description: 2OG-Fe(II) oxygenase superfamily
  misc_feature (1)..(378): Bit score of 367.2 for HMM based on sequences of Figure 1
  misc_feature (1)..(378): Functional Homolog Of SEQ ID NO. 471
MVYISNAQDASKLIVTAKGGGGEADDAAAAAAAVVLDLWRQPAKIPAPFVWPRADVALPPSSPPTGELDVPVVDLAAALRDAAGMRRAVAQVAAACASHGFFQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMALTNGRYKSCLHRAVVHREQERRSLAFFLCPREDRVVRPPAGAGAGERRLYPDFTWADFMRFTQRHYRADTRTLDAFARWLRPPACSGAAPVVGPPTTATQAATV

SEQ ID NO: 537 - protein, 376 aa, Arabidopsis thaliana
  misc_feature (1)..(376): Public GI ID no. 15219842
  misc_feature (225)..(322): Pfam Name: 2OG-FeII_Oxy Pfam Description: 2OG-Fe(II) oxygenase superfamily
  misc_feature (1)..(376): Bit score of 587.9 for HMM based on sequences of Figure 1
  misc_feature (1)..(376): Functional Homolog Of SEQ ID NO. 471
MECIIKLPQRFNKNKSKKNPLRIFDSTVLNHQPDHIPQEFVWPDHEKPSKNVPILQVPVIDLAGFLSNDPLLVSEAERLVSEAAKKHGFFLVTNHGVDERLLSTAHKLMDTFFKSPNYEKLKAQRKVGETTGYASSFVGRFKENLPWKETLSFSFSPTEKSENYSQTVKNYISKTMGDGYKDFGSVYQEYAETMSNLSLKIMELLGMSLGIKREHFREFFEDNESIFRLNYYPKCKQPDLVLGTGPHCDPTSLTILQQDQVSGLQVFVDNQWQSIPPIPQALVVNIGDTLMALTNGIYKSCLHRAVVNGETTRKTLAFFLCPKVDKVVKPPSELEGERAYPDFTWSMFLEFTMKHYRADMNTLEEFTNWLKNKGSF

SEQ ID NO: 538 - protein, 385 aa, Phaseolus vulgaris
  misc_feature (1)..(385): Public GI ID no. 2108432
  misc_feature (226)..(323): Pfam Name: 2OG-FeII_Oxy Pfam Description: 2OG-Fe(II) oxygenase superfamily
  misc_feature (1)..(385): Bit score of 697.2 for HMM based on sequences of Figure 1
  misc_feature (1)..(385): Functional Homolog Of SEQ ID NO. 471
MAIDMHPIPIMPQPSNQEIKEQDQHPLVFDASLLRHQLHIPSQFVWPDEEKACLNEPELPVPFIDLGGFLSGDPLAATEASRLVGEACQKHGFFLVVNHGIQQQLISDAHLYMDHFFALPLSHKQRAQRMPGEHCGYASSFTGRFSSKLPWKETLSFQYSPRNDSQTLVKDYLCDKMGKEFEKFGNVYQDYCEAMSNLSLGIMELLGLSLGVGRGYFREFFEENNSIMRLNYYPPCQKPDLTLGTGPHCDPTSLTILHQDQVGGLQVCVDNEWHSIKPDVNAFVVNVGDTFMALSNGRYKSCLHRAVVNSETTRKSLAFFLCPRSDKVVSPPCELVDKLSPRLYPDFTWPMLLEFTQKHYRADMKTLEAFTNWLQRRSNFDNHIM

SEQ ID NO: 539 - protein, 369 aa, Lactuca sativa
  misc_feature (1)..(369): Public GI ID no. 4164143
  misc_feature (215)..(313): Pfam Name: 2OG-FeII_Oxy Pfam Description: 2OG-Fe(II) oxygenase superfamily
  misc_feature (1)..(369): Bit score of 712.7 for HMM based on sequences of Figure 1
  misc_feature (1)..(369): Functional Homolog Of SEQ ID NO. 471
MPSLHKEHINAQPKPLVFDSLILQHETNIPEQFIWPDHEKPNSQKAKELAVPLVDLRGFLSGRASSAKEASVVVGEACKKHGFFLVTNHGVDASLIVDAHRYMDLFFELPFLDKQRVQRKIGESCGYASSFTGRFSSKLPWKETLSFQFSGEKKSSKIVEEYFEKTMGKEFARLGKVYQEYCNAMSRLSLGIMELLGMSLGVEQSHFKEFFKENDSIMRLNYYPPCQKPDLTLGTGPHCDPTSLTILHQDTVGGLEVFIDNEWRSIAPNLNTFVVNIGDTFMALSNGQYRSCLHRAVVNNKIHRKSLAFFLCPKKDKVVSPPDELVDEKNPRIYPDFTWSTFLEFTQKHYRADMNTLQAFTNWIQQKNS

SEQ ID NO: 540 - protein, 320 aa, Oryza sativa
  misc_feature (1)..(320): Public GI ID no. 297724127
  misc_feature (1)..(320): Oryza sativa Japonica Group
  misc_feature (236)..(307): Pfam Name: 2OG-FeII_Oxy Pfam Description: 2OG-Fe(II) oxygenase superfamily
  misc_feature (1)..(320): Bit score of 304.1 for HMM based on sequences of Figure 1
  misc_feature (1)..(320): Functional Homolog Of SEQ ID NO. 471
MVYISNAQDASKLIVTAKGGGGEADDAAASSAAVVLDLWRQPAKIPAPFVWPRADVALPPSSPPTGELDVPVVDLAAALRDAAGMRRAVAQVAAACASHGFFQVSGHGVPPSLARAALDGAAGFFRLPPAAKQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMACSDIRDLSLTTVSKQC

SEQ ID NO: 541 - protein, 389 aa, Beta vulgaris
  misc_feature (1)..(389): Public GI ID no. 21322508
  misc_feature (229)..(326): Pfam Name: 2OG-FeII_Oxy Pfam Description: 2OG-Fe(II) oxygenase superfamily
  misc_feature (1)..(389): Bit score of 680.9 for HMM based on sequences of Figure 1
  misc_feature (1)..(389): Functional Homolog Of SEQ ID NO. 471
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 542 - protein, 371 aa, Zea mays
  misc_feature (1)..(371): Public GI ID no. 162458757
  misc_feature (206)..(306): Pfam Name: 2OG-FeII_Oxy Pfam Description: 2OG-Fe(II) oxygenase superfamily
  misc_feature (1)..(371): Bit score of 664.0 for HMM based on sequences of Figure 1
  misc_feature (1)..(371): Functional Homolog Of SEQ ID NO. 471
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSVRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTRSNGGQHLLEKK

SEQ ID NO: 543 - DNA, 1174 bp, Zea mays
  misc_feature (1)..(1174): Ceres Clone ID no. 100845866
  misc_feature (1)..(1174): Encodes the peptide sequence at SEQ ID NO. 544
aagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaycacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggtt

SEQ ID NO: 544 - protein, 352 aa, Zea mays
  misc_feature (1)..(352): Ceres Clone ID no. 100845866
  misc_feature (235)..(304): Pfam Name: 2OG-FeII_Oxy Pfam Description: 2OG-Fe(II) oxygenase superfamily
  misc_feature (1)..(352): Bit score of 345.3 for HMM based on sequences of Figure 1
  misc_feature (1)..(352): Functional Homolog Of SEQ ID NO. 471
  misc_feature (168)..(168): Xaa is any aa, unknown, or other
MDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGXHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMVTKRKRSLLCFPWPLLSCVYIQLSSLCAVISRILVDLNGQVITARTRRHVM

SEQ ID NO: 545 - protein, 413 aa, Sorghum bicolor
  misc_feature (1)..(413): Public GI ID no. 242055211
  misc_feature (253)..(350): Pfam Name: 2OG-FeII_Oxy Pfam Description: 2OG-Fe(II) oxygenase superfamily
  misc_feature (1)..(413): Bit score of 506.7 for HMM based on sequences of Figure 1
  misc_feature (1)..(413): Functional Homolog Of SEQ ID NO. 471
MVSQERQEPALPLPSNSSSAKRAAASMDASSPAPPLLLRAPTPSPSIDLPAAAGKAAAVFDLRREPKIPAPFLWPHEEARPTSAAELEVPVVDVGVLRNGDRAGLRRAAAQVASACATHGFFQVCGHGVDAALGRAALDGASDFFRLPLADKQRARRVPGTVSGYTSAHADRFASKLPWKETLSFGFHDGAASPVVVDYFTGTLGQDFEPMGRVYQRYCEKMKELSLTIMELLELSLGVERGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRQERRSLAFFLCPREDRVVRPPASSATPRQYPDFTWADLMRFTQRHYRADTRTLDAFTRWLSHGPVPAQEAAAPCT

SEQ ID NO: 546 - protein, 407 aa, Oryza alta
  misc_feature (1)..(407): Public GI ID no. 210142298
  misc_feature (244)..(341): Pfam Name: 2OG-FeII_Oxy Pfam Description: 2OG-Fe(II) oxygenase superfamily
  misc_feature (1)..(407): Bit score of 491.3 for HMM based on sequences of Figure 1
  misc_feature (1)..(407): Functional Homolog Of SEQ ID NO. 471
MVAEPPAPPQHQPSSHPTHRPAAAATPAMDSTGSAAPGGIGATVPTVAAVCDLRLEPKIPEPFVWPNADARPASAAELDMPVVDVGVLRNGNAEGLRRAAAQVASACATHGFFQVSGHGVDAALARAALDGASDFFRLPLAEKRRARRVPGTVSGYTSAHADRFASKLPWKETLSFGFHDRGATPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGDWRPVSPVPGAMVINIGDTFMALSNGRYKSCLHRAVVNRRQERRSLAFFLCPREDRVVRPPPSAATPRHYPDFTWADLMRFTQRHYRADTRTLDAFTRWLAPPPDAAAAAPVQVEAAS

SEQ ID NO: 547 - protein, 409 aa, Hordeum vulgare
  misc_feature (1)..(409): Public GI ID no. 326529611
  misc_feature (1)..(409): Hordeum vulgare subsp. vulgare
  misc_feature (247)..(345): Pfam Name: 2OG-FeII_Oxy Pfam Description: 2OG-Fe(II) oxygenase superfamily
  misc_feature (1)..(409): Bit score of 468.4 for HMM based on sequences of Figure 1
  misc_feature (1)..(409): Functional Homolog Of SEQ ID NO. 471
MVDVSNFVEANGNAAVSIPAMEVAGSPHVPFVPRDANATDSKNAKDVLDLWRQQKQIPAPFIWPHADARPSSILELDVPVVDIGAALHSAAGMARAAAQVAEACASHGFFQVTGHGVDPALAQAALDGAADFFRLPLATKQRARRSPGTVKGYASAHADRFAAKLPWKETLSFIHNHVHEDVGARASSHVVDYFTSALGDDFMHLGEVYQEYCEAMEDASLAIMEVLGVSLGLGRGYYRDFFADGSSIMRCNYYPRCPEPDRTLGTGPHCDPSALTILLQDGEVDGLQVLVDGAWRSVRPKPGELVVNIGDTFMALSNGRYKSCLHRAVVHREKERRSLAYFLAPREDRVVRPPPSPAPAPRLYPDFTWAELMRFTQRHYRADARTLDAFACWLDLPSCPTTPQAQGTV

SEQ ID NO: 548 - protein, 377 aa, Arabidopsis thaliana
  misc_feature (1)..(377): Public GI ID no. 1109695
  misc_feature (224)..(322): Pfam Name: 2OG-FeII_Oxy Pfam Description: 2OG-Fe(II) oxygenase superfamily
  misc_feature (1)..(377): Bit score of 678.1 for HMM based on sequences of Figure 1
  misc_feature (1)..(377): Functional Homolog Of SEQ ID NO. 471
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSKSERKSLAFFLCPKKDRVVTPPRELLDSITSRRYPDFTWSMFLEFTQKHYRADMNTLQAFSDWLTKPI

SEQ ID NO: 549 - protein, 377 aa, Chrysanthemum x morifolium
  misc_feature (1)..(377): Public GI ID no. 169403818
  misc_feature (224)..(321): Pfam Name: 2OG-FeII_Oxy Pfam Description: 2OG-Fe(II) oxygenase superfamily
  misc_feature (1)..(377): Bit score of 726.8 for HMM based on sequences of Figure 1
  misc_feature (1)..(377): Functional Homolog Of SEQ ID NO. 471
MAIDCMIKTTSNMPSLKEDQRKSFVFDASVLKHETNIPQQFIWPDHEKPNSQKSKELEVPLIDLGGFLSGRSSSANDASSLVGEACQKHGFFLVVNHGVDANLISDAQRYMDLFFELPLSVKQRAQRKVGESCGYASSFTGRFSSKLPWKETLSFRFSAEENASNIVKDYFENTMGEEFIRLGKVYQEYCNAMSRLSLGIMELLGMSLGVSRAYYKDFFEEHNSIMRLNYYPPCQKPDLTLGTGPHCDPTSLTILHQDNVGGLEVFVDNEWRLIVPNSNAFVVNIGDTFMALSNGRYKSCLHRAVVNSKTTRKSLAFFLCPKKDKVVIPPKELVDENNPRIYPDFTWSTFLEFTQKHYRADKNTLQAFSTWVRQKTT

SEQ ID NO: 550 - protein, 380 aa, Pisum sativum
  misc_feature (1)..(380): Public GI ID no. 2108428
  misc_feature (227)..(324): Pfam Name: 2OG-FeII_Oxy Pfam Description: 2OG-Fe(II) oxygenase superfamily
  misc_feature (1)..(380): Bit score of 709.2 for HMM based on sequences of Figure 1
  misc_feature (1)..(380): Functional Homolog Of SEQ ID NO. 471
MAIECITSSAKLMTQKSDKNENEESSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 551 - protein, 380 aa, Pisum sativum
  misc_feature (1)..(380): Public GI ID no. 1848146
  misc_feature (227)..(324): Pfam Name: 2OG-FeII_Oxy Pfam Description: 2OG-Fe(II) oxygenase superfamily
  misc_feature (1)..(380): Bit score of 704.8 for HMM based on sequences of Figure 1
  misc_feature (1)..(380): Functional Homolog Of SEQ ID NO. 471
MAIECITSSAKLMTQKSDKNENEESSKLVFDASFLKNQLNLPKRFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNPSHIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 552 - protein, 394 aa, Oryza meridionalis
  misc_feature (1)..(394): Public GI ID no. 210142288
  misc_feature (227)..(324): Pfam Name: 2OG-FeII_Oxy Pfam Description: 2OG-Fe(II) oxygenase superfamily
  misc_feature (1)..(394): Bit score of 493.1 for HMM based on sequences of Figure 1
  misc_feature (1)..(394): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPPDAAAATAAAATAQVEAAS

SEQ ID NO: 553 - protein, 362 aa, Lolium perenne
  misc_feature (1)..(362): Public GI ID no. 13625525
  misc_feature (201)..(298): Pfam Name: 2OG-FeII_Oxy Pfam Description: 2OG-Fe(II) oxygenase superfamily
  misc_feature (1)..(362): Bit score of 685.2 for HMM based on sequences of Figure 1
  misc_feature (1)..(362): Functional Homolog Of SEQ ID NO. 471
MVQPVFDAALLSAQSDIPSQFIWPADESPTPDATEELHVPLIDIGGLLSGDREAAAEVTRLVGDACERHGFFQVVNHGIDAELLGHARCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 554 - protein, 179 aa, Saccharum officinarum
  misc_feature (1)..(179): Public GI ID no. 188474853
  misc_feature (111)..(178): Pfam Name: 2OG-FeII_Oxy Pfam Description: 2OG-Fe(II) oxygenase superfamily
  misc_feature (1)..(179): Bit score of 348.4 for HMM based on sequences of Figure 1
  misc_feature (1)..(179): Functional Homolog Of SEQ ID NO. 471
MDAFFTLPLSDKQRAQRRQGDSCGYASSFTGRFASKLPWKETLSFRYSGDDDDAVVDYFVDKLGEEYRHHGEVYGRYCSEMSRLSLELMEVLGDSLGVGRRHFRRFFQGNDSVMRLNYYPPCQRPYDTLGTGPHCDPTSLTILHQDHVGGLQVFDAATQHWRSIRPHPGAFVVNIGDTF

SEQ ID NO: 555 - protein, 365 aa, Triticum aestivum
  misc_feature (1)..(365): Public GI ID no. 75276876
  misc_feature (201)..(299): Pfam Name: 2OG-FeII_Oxy Pfam Description: 2OG-Fe(II) oxygenase superfamily
  misc_feature (1)..(365): Bit score of 694.9 for HMM based on sequences of Figure 1
  misc_feature (1)..(365): Functional Homolog Of SEQ ID NO. 471
MVRPVFDAAVLSGRSDIPSQFIWPEGESPTPDAAEELHVPLINIGGMLSGDAAAAAEVTRLVGEACERHGFFQVVNHGIDAELLADAHRCVDNFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDASNPRAYPDFTWRSLLDFTQKHYRADMKTLEVFSSWIVQQQQGQLALQPAMT

SEQ ID NO: 556 - protein, 389 aa, Oryza sativa
  misc_feature (1)..(389): Public GI ID no. 335056059
  misc_feature (1)..(389): Oryza sativa Indica Group
  misc_feature (227)..(324): Pfam Name: 2OG-FeII_Oxy Pfam Description: 2OG-Fe(II) oxygenase superfamily
  misc_feature (1)..(389): Bit score of 479.7 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAGVNQRRERRSLAFFLCPREDRGVRPPPSAPPPRHYPDFTWADLMRFTQRHYRANTRTLDAFTRWLAPPAANAAATAQVEAAS

SEQ ID NO: 557 - DNA, 1370 bp, Glycine max
  misc_feature (1)..(1370): Ceres Clone ID no. 624633
  misc_feature (1)..(1370): Encodes the peptide sequence at SEQ ID NO. 558
aacaagcggccttggcttttctttcatctcttctaccaacctattcttattattatttcactctccctctcttcctcgttacaacaacaacaacaacaacaacttcattctctgcctcttctctccactctcttaaccaacaaacaaccttgtattattattaatatataattaatgcaatggcaatagactgcataacaagcatacccatgatgcctcaaccaccaacccaagaaacaaccaaagaacaagaacagcagcagccactggtgtttgatgcctcagtcctcagacaccaacttcacataccctcacaattcatctggcccgatgaagaaaaagcatgcttggacgaacccgagttgtttgtcccattcattgacttgggagggttcctctctggtgacccagttgctgcaacggaagcctcgaggcttgctggtgaagcatgccaaaagcatggtttttttctggttgtgaatcatgggattgatcaacggttgatatgtgatgctcatctttacatggagcacttctttgggcttcccctgtctcagaaacagagggctcagaggaagccaggggagcactgtggctatgctagtagcttcactggaaggttctcctctaagctcccttggaaagagacactttcctttcagtactcagctgacaaaaactcatcaccagcccttgtcaaagattacttgtgcagtaaaatgggcaaagagtttgagcaatttgggaaggtttaccaggactactgtgatgccatgagcaatctttctttaggtataatggagcttctaggaatgagccttggagttggtagagcctgctttagggagttctttgaagagaatagttcaataatgaggctgaattactaccctccgtgtcaaaagcctgacctcactttaggcactggacctcattgtgatccaacatctttgaccattcttcaccaggaccaagtgggaggcttgcaagtttgtgttgacaatgagtggcattccattaagccggatctcaatgcttttgttgtcaatgttggtgataccttcatggctctttcgaatgggagatacaagagttgcttgcatagggcagtggtgaatagccagacaacaagaaaatctcttgctttctttttgtgtccaagaagtgacaaggtggtaagtccaccatgtgaattagtggacaatttgagcccaaggctatacccagattttacatggcccatgctgctggagttcactcaaaagcattacagagctgacatgaaaacccttgaggcatttgccaactggctccggaaaagtaactgaaatttcaagaagcacatcaagggcccttgatctacccaaaac

SEQ ID NO: 558 - protein, 382 aa, Glycine max
  misc_feature (1)..(382): Ceres Clone ID no. 624633
  misc_feature (230)..(327): Pfam Name: 2OG-FeII_Oxy Pfam Description: 2OG-Fe(II) oxygenase superfamily
  misc_feature (1)..(382): Bit score of 697.3 for HMM based on sequences of Figure 1
  misc_feature (1)..(382): Functional Homolog Of SEQ ID NO. 471
MAIDCITSIPMMPQPPTQETTKEQEQQQPLVFDASVLRHQLHIPSQFIWPDEEKACLDEPELFVPFIDLGGFLSGDPVAATEASRLAGEACQKHGFFLVVNHGIDQRLICDAHLYMEHFFGLPLSQKQRAQRKPGEHCGYASSFTGRFSSKLPWKETLSFQYSADKNSSPALVKDYLCSKMGKEFEQFGKVYQDYCDAMSNLSLGIMELLGMSLGVGRACFREFFEENSSIMRLNYYPPCQKPDLTLGTGPHCDPTSLTILHQDQVGGLQVCVDNEWHSIKPDLNAFVVNVGDTFMALSNGRYKSCLHRAVVNSQTTRKSLAFFLCPRSDKVVSPPCELVDNLSPRLYPDFTWPMLLEFTQKHYRADMKTLEAFANWLRKSN

SEQ ID NO: 559 - protein, 389 aa, Oryza granulata
  misc_feature (1)..(389): Public GI ID no. 210142302
  misc_feature (227)..(324): Pfam Name: 2OG-FeII_Oxy Pfam Description: 2OG-Fe(II) oxygenase superfamily
  misc_feature (1)..(389): Bit score of 494.7 for HMM based on sequences of Figure 1
  misc_feature (1)..(389): Functional Homolog Of SEQ ID NO. 471
MDTTTGPALAPPVSRPAAPPGGIDAAGAEAAAVCDLRKEPKIPEPFVWPNADARPASADALDMPVVDVGVLRNGDAAGLRRAAAQVAAACATHGFFQVSGHGVDAALARAALDGASEFFRLPLAEKRRARRVPGTVSGYTSAHADRFASKLPWKETLSFGFHDRGDTPVVADYFASTLGQDFEPLGRVYQKYCEEMKELSLTIMELLELSLGVERGYYREFFADSSSIMRCNYYPPCPEPERTLGTGPHCDPTALTILLQDDVGGLEVLVDGDWRPVNPVPGAMVINIGDTFMALSNGRYKSCLHRAVVNRRQERRSLAFFLCPREDRVVRPPPSAATPRHYPDFTWADLMRFTQRHYRADTRTLDAFTRWLAPPADAAATAQQLEAAS

SEQ ID NO: 560 - DNA, 1442 bp, Triticum aestivum
  misc_feature (1)..(1442): Ceres Clone ID no. 818172
  misc_feature (1)..(1442): Encodes the peptide sequence at SEQ ID NO. 561
agacacccaacttgtcaccaccatcctctcctcctcctcctcctctatccagtgagctcgagtcggcactgcactctctctgccagctccggatcgatctcggcttcttgatcgatccatcgtttgttgtctggcctagcacactcgggttcttggtccagtcgatcatggtgcagccggtgttcgacgcggcggtgctgagcggccgggcggacatcccgtcgcagttcatctggcccgagggcgagagcccgaccccggacgccgccgaggagctgcacgtcccgctcatcgacatcggcggcatgctctccggcgaccccgccgcggccgccgaggtgacgcgcctcgtgggcgaggcctgcgagcggcacggcttcttccaggtcgtgaaccacggtatcgacgccgagctgctggccgacgcgcaccgctgcgtggacaacttcttcacgatgcccctcccggagaagcagcgcgcgctgcgccaccccggcgagtcgtgcggctacgccagcagcttcaccggccggttcgcgtccaagctgccgtggaaggagaccctgtccttccgctcctgcccctccgaccccgccctcgtcgtcgactacatcgtcgccaccctcggcgaggaccaccgccgcctcggggaggtgtacgctcggtactgctcggagatgagccgtctgtcgctggagatcatggaggtgctcggggagagcctgggcgtcggccgcgcccactaccggcgcttcttcgagggcaacgactccatcatgcgcctcaactactacccgccgtgccagcggccgttggagacgctgggcacgggcccgcattgcgacccgacgtccctgaccatcctccaccaggacaacgtcggcggcctgcaggtgcacacggagggccggtggcgctccatccgaccccgcgccgacgccttcgtggtcaacatcggcgacaccttcatggcgctgtctaacggacggtacaagagctgcctccacagagcggtggtgaacagccgggtcccgaggaagtcgctggccttcttcctgtgcccggagatggacaaggtggtggcgccgccggggacgctggtggacgccgccaacccgcgcgcctacccggacttcacgtggcggtcgctgctggacttcacgcagaagcactaccgggccgacatgaagaccctcgaggtcttctcctcctggatcgtccagcagcagcagccccagcccgccaggacatgatggattgctctgctcctcccaccattagccagccattgattcagcttagctgctgagactgagaaaagagagacatcgtcatccgtcgatcgaatgttattattacagcttaattggttgatctagtggtagcacgtacgtacgaagaagcatggatggatggcaggatttcctagatgataatttcct

SEQ ID NO: 561 - protein, 361 aa, Triticum aestivum
  misc_feature (1)..(361): Ceres Clone ID no. 818172
  misc_feature (1)..(361): Public GI ID no. 75219001
  misc_feature (201)..(299): Pfam Name: 2OG-FeII_Oxy Pfam Description: 2OG-Fe(II) oxygenase superfamily
  misc_feature (1)..(361): Bit score of 697.6 for HMM based on sequences of Figure 1
  misc_feature (1)..(361): Functional Homolog Of SEQ ID NO. 471
MVQPVFDAAVLSGRADIPSQFIWPEGESPTPDAAEELHVPLIDIGGMLSGDPAAAAEVTRLVGEACERHGFFQVVNHGIDAELLADAHRCVDNFFTMPLPEKQRALRHPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWIVQQQQPQPART

SEQ ID NO: 562 - protein, 380 aa, Arabidopsis lyrata
  misc_feature (1)..(380): Public GI ID no. 297810833
  misc_feature (1)..(380): Arabidopsis lyrata subsp. lyrata
  misc_feature (224)..(321): Pfam Name: 2OG-FeII_Oxy Pfam Description: 2OG-Fe(II) oxygenase superfamily
  misc_feature (1)..(380): Bit score of 615.6 for HMM based on sequences of Figure 1
  misc_feature (1)..(380): Functional Homolog Of SEQ ID NO. 471
MAMECIATVPQRFSENKTKEDSSIFDAKLLNQHSNHIPQQFVWPDHEKPSTDVQPLQVPLIDLSGFLSGDSFLVSEATRLVSEAATKHGFFLVTNHGVDESLLSRAYLHMDSFFKAPACEKQKAQRNWGESSGYASSFVGRFSSKLPWKETLSFKFSPEEKIHTETVKEYVSKKMGDGYEDFGKVYQEYAEAMNTLSLKIMELLGMSLGLERRYFREFFEENESIFRLNYYPQCKQPELALGTGPHCDPTSLTILHQDQVSGLQVFVDNKWQSIPPNPHSFVVNIGDTFMALTNGRYKSCLHRAVVNSERERKTFAFFLCPKGEKVVKPPEELVGGVMSGQREYPDFTWSMFLEFTQKHYRADMNTLEEFSIWLKNRRSF

SEQ ID NO: 563 - protein, 389 aa, Oryza sativa
  misc_feature (1)..(389): Public GI ID no. 115441469
  misc_feature (1)..(389): Oryza sativa Japonica Group
  misc_feature (227)..(324): Pfam Name: 2OG-FeII_Oxy Pfam Description: 2OG-Fe(II) oxygenase superfamily
  misc_feature (1)..(389): Bit score of 491.3 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 564 - protein, 378 aa, Cucurbita maxima
  misc_feature (1)..(378): Public GI ID no. 27124556
  misc_feature (215)..(313): Pfam Name: 2OG-FeII_Oxy Pfam Description: 2OG-Fe(II) oxygenase superfamily
  misc_feature (1)..(378): Bit score of 692.0 for HMM based on sequences of Figure 1
  misc_feature (1)..(378): Functional Homolog Of SEQ ID NO. 471
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 565 - DNA, 1602 bp, Triticum aestivum
  misc_feature (1)..(1602): Ceres Clone ID no. 639483
  misc_feature (1)..(1602): Encodes the peptide sequence at SEQ ID NO. 566
acactcactcgcggctagctcacacacctctcatctcatggtgctccagaccgctcagcaagaaccatccctgacgcgtccgcctcactgcagcgtcgccagcgcgcgctcgccggcggccatggacaccagccctgcaactcccctgctcctccagcctcctgctcccagcattgacccgttcgccgccaaggcggccgtcaacaagggcggcggcgcggcaaccgcggtgtacgacctccggagggagccgaagatccccgccccgttcgtgtggccgcacgccgaggtgcgccccaccacggcccaggagctggccgtgccggtggtggacgtgggcgtgctgcgcaatggcgacgccgcggggctccgccgcgccgtggcgcaggtggccgcggcgtgcgccacgcacgggttcttccaggtgtccgggcacggcgtggacgaggccctggcgcgcgcggcgctggacggcgcgagcggcttcttccggctgcccctggccgagaagcagcgcgcgcggcgcgtcccggggaccgtgtccgggtacacgagcgcgcacgccgaccggttcgcctccaagctcccctggaaggagaccctctccttcggcttccacgaccgcgccggcgccgcgcccgtcgtggtggactacttcaccagcaccctcgggccggactacgagccaatggggagggtgtaccaggagtactgcgggaagatgaaggagctgtcgctgaggatcatggagctgctggagctgagccagggcgtggagaagcgcgggtactaccgggagttcttcgcggacagcagctccatcatgcggtgcaactactacccgccgtgcccggagccggagcgcacgctgggcacgggcccgcactgcgaccccacggcgctcaccatcctactgcaggacgacgtgggcgggctggaggtcctcgtcgacggcgactggcgccccgtccgccccgtccccggcgccatggtcatcaacatcggcgacaccttcatggcgctgtcgaacgggcggtacaagagctgcctgcaccgcgcggtggtgaaccggcggcaggagcggcggtcgctggccttcttcctgtgcccgcgcgaggaccgcgtggtgcggccgccgccgggcctgaggagcccgcggcggtacccggacttcacctgggctgacctcatgcgcttcacgcagcgccactaccgcgccgacacgcgcaccctcgacgccttcacccagtggttctcctcctcctcctcctcggcccaggaggcggcctgattctgctctgccacgaaacgatcggtccacacgggctgattcgccccgaggatcgcgacacggaatttttgtcgggaccagcccacgtgcgcgcgcgccccgctctcaggtgcggtgggcccgggcggagtggtgcccacgtggatttccggccccacaccaccttccatttttggacgctggctcgcgtccccccctcctagccttgtttgtcacgactcgccatatgcatgccccctcctcacctagtgtacataccatggaaatcatggaatatatataatataatatatataaacgcatttcctgcc

SEQ ID NO: 566 - protein, 417 aa, Triticum aestivum
  misc_feature (1)..(417): Ceres Clone ID no. 639483
  misc_feature (261)..(358): Pfam Name: 2OG-FeII_Oxy Pfam Description: 2OG-Fe(II) oxygenase superfamily
  misc_feature (1)..(417): Bit score of 493.0 for HMM based on sequences of Figure 1
  misc_feature (1)..(417): Functional Homolog Of SEQ ID NO. 471
MVLQTAQQEPSLTRPPHCSVASARSPAAMDTSPATPLLLQPPAPSIDPFAAKAAVNKGGGAATAVYDLRREPKIPAPFVWPHAEVRPTTAQELAVPVVDVGVLRNGDAAGLRRAVAQVAAACATHGFFQVSGHGVDEALARAALDGASGFFRLPLAEKQRARRVPGTVSGYTSAHADRFASKLPWKETLSFGFHDRAGAAPVVVDYFTSTLGPDYEPMGRVYQEYCGKMKELSLRIMELLELSQGVEKRGYYREFFADSSSIMRCNYYPPCPEPERTLGTGPHCDPTALTILLQDDVGGLEVLVDGDWRPVRPVPGAMVINIGDTFMALSNGRYKSCLHRAVVNRRQERRSLAFFLCPREDRVVRPPPGLRSPRRYPDFTWADLMRFTQRHYRADTRTLDAFTQWFSSSSSSAQEAA

SEQ ID NO: 567 - protein, 359 aa, Dasypyrum villosum
  misc_feature (1)..(359): Public GI ID no. 255927091
  misc_feature (201)..(299): Pfam Name: 2OG-FeII_Oxy Pfam Description: 2OG-Fe(II) oxygenase superfamily
  misc_feature (1)..(359): Bit score of 689.6 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCADAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKPLAFFLCPEMDKVVAPPGTLVDAANPRAYPDFTWRSLLDFTQKHYRADMKTLEVFSSWVVQQQQAAMT

SEQ ID NO: 568 - protein, 408 aa, Oryza sativa
  misc_feature (1)..(408): Public GI ID no. 48475183
  misc_feature (1)..(408): Oryza sativa Japonica Group
  misc_feature (236)..(334): Pfam Name: 2OG-FeII_Oxy Pfam Description: 2OG-Fe(II) oxygenase superfamily
  misc_feature (1)..(408): Bit score of 439.4 for HMM based on sequences of Figure 1
  misc_feature (1)..(408): Functional Homolog Of SEQ ID NO. 471
MVYISNAQDASKLIVTAKGGGGEADDAAASSAAVVLDLWRQPAKIPAPFVWPRADVALPPSSPPTGELDVPVVDLAAALRDAAGMRRAVAQVAAACASHGFFQVSGHGVPPSLARAALDGAAGFFRLPPAAKQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMALTNGRYKSCLHRAVVHREQERRSLAFFLCPREDRVVRPPAGAGAGERRLYPDFTWADFMRFTQRHYRADTRTLDAFARWLRPPACSGAAPVVGPPTTATQAATV

SEQ ID NO: 569 - protein, 382 aa, Lolium perenne
  misc_feature (1)..(382): Public GI ID no. 13625519
  misc_feature (202)..(299): Pfam Name: 2OG-FeII_Oxy Pfam Description: 2OG-Fe(II) oxygenase superfamily
  misc_feature (1)..(382): Bit score of 691.5 for HMM based on sequences of Figure 1
  misc_feature (1)..(382): Functional Homolog Of SEQ ID NO. 471
MVQPVFDAALLSGQSDIPSQFIWPADESPSPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNGTLGTGPHCDPTSLTILHQDDVGGLQVHADGRWLSIRPRADAFVVNIGDTFMALSNGRYKSCLHRAVVNSRVPRKSLAFFLCPEMDKVVAPPGTSVDEANPRAYPDFTWRALLDFTQKHYRADMKTLEVFSDWIQQGHQPAATTTTTQDQRTYTASASLHLLACCT

SEQ ID NO: 570 - protein, 395 aa, Oryza longistaminata
  misc_feature (1)..(395): Public GI ID no. 210142290
  misc_feature (227)..(324): Pfam Name: 2OG-FeII_Oxy Pfam Description: 2OG-Fe(II) oxygenase superfamily
  misc_feature (1)..(395): Bit score of 493.3 for HMM based on sequences of Figure 1
  misc_feature (1)..(395): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAAAATTAATAQVEAAS

SEQ ID NO: 571 - protein, 379 aa, Nicotiana tabacum
  misc_feature (1)..(379): Public GI ID no. 30519873
  misc_feature (224)..(321): Pfam Name: 2OG-FeII_Oxy Pfam Description: 2OG-Fe(II) oxygenase superfamily
  misc_feature (1)..(379): Bit score of 742.6 for HMM based on sequences of Figure 1
  misc_feature (1)..(379): Functional Homolog Of SEQ ID NO. 471
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLCPKKDKVVSPPNELVDTNNPRIYPDFTWPTLLEFTQKHYRADMNTLQTFSNWLKQKTAQV

SEQ ID NO: 572 - protein, 382 aa, Vitis vinifera
  misc_feature (1)..(382): Public GI ID no. 225453833
  misc_feature (228)..(326): Pfam Name: 2OG-FeII_Oxy Pfam Description: 2OG-Fe(II) oxygenase superfamily
  misc_feature (1)..(382): Bit score of 703.7 for HMM based on sequences of Figure 1
  misc_feature (1)..(382): Functional Homolog Of SEQ ID NO. 471
MECCTSTMLMPPPRPPLKPLDEANTQHQSLVFDASVLKYQSTIPSQFIWPDEEKPCAKPPELLVPPIDLGGFLSADPLAISNAARLVNEACRKHGFFLVVNHGVDAQLVTEAHKNMDFFFNMSLSEKQRAQRKVGDHCGYASSFTGRFSTKLPWKETLSFRYCDDDQSSRIIEKYFSNVMGEDFKQFGRVYQQYCEAMSRLSLGIMELLGMSLGVGREYFREFFEGNDSIMRLNYYPPCQKPNLTLGTGPHCDPTSLTILHQDQVSGLQVFVDEKWHSISPNSEAFVVNIGDTFMALSNGIYKSCLHRAVVNSQTPRKSLAFFLCPKMEKVVSPPNGLVDANNPRIYPDFTWSSLLEFTQKHYRADTKTLHVFSNWLQQKNN

SEQ ID NO: 573 - protein, 324 aa, Streptomyces sviceus
  misc_feature (1)..(324): Public GI ID no. 297201566
  misc_feature (1)..(324): Streptomyces sviceus ATCC 29083
  misc_feature (182)..(284): Pfam Name: 2OG-FeII_Oxy Pfam Description: 2OG-Fe(II) oxygenase superfamily
  misc_feature (1)..(324): Bit score of 109.0 for HMM based on sequences of Figure 1
  misc_feature (1)..(324): Functional Homolog Of SEQ ID NO. 471
MNDTPQPRIPTVDLGPWLSGDPDARAATARTLDRALQTAGFFLVTGHGVDPALRSGIREAARAFFRMPAETKKAYEAKVGGRGWLGPGAEANGYSEGTQTPPDLKESLTFATHEPFEDPVVNAEWYAPNVWPAEVPKLRTLCEEYLEKMGELEKQLLSLLGEALGLAPDFFSRHMDHPTYGFNINWYPGTEVTGDPEPGQFRIGPHTDFGTVTILDRQAGKGGLQVFTDEGGWEDAPFDPDAFTINIGDLMARWTGDRWRSGRHRVLPPPADAPAEELMSLVYFGECTPGTTVESVPAPVGRVAYEPVDSHVYLRAKLDSITVG

SEQ ID NO: 574 - protein, 370 aa, Selaginella moellendorffii
  misc_feature (1)..(370): Public GI ID no. 159902527
  misc_feature (220)..(317): Pfam Name: 2OG-FeII_Oxy Pfam Description: 2OG-Fe(II) oxygenase superfamily
  misc_feature (1)..(370): Bit score of 234.2 for HMM based on sequences of Figure 1
  misc_feature (1)..(370): Functional Homolog Of SEQ ID NO. 471
MVVKLPKHSKMAPTQGGTQGGVDYKLTTFLQGSLTLDDYVWSQEEWPKVAYNDYNDEDTVPIIDISLLRSEDAATRSKGLKDLMEAAREWGFFRLVNHGVLSDVTEKLESDGKELFALPLEQKKKAVRLPESIIGYYFGAESVFSKAWLEAFHFSGDKEVTDNMIRQVSPENFNELSASVHNYIDAYQKLAIEVVELMAIALGLEPSTFSKYTATKGDKSTVRVCYYPPCPQPQQTLGQRPHADPILITIVHQDDVGGLQILKNNRWIAVKPEPGTVVVNVGDTLQVLSNDIYPSVQHQVVLNSERSRLSMAFFLIPEADALIVPAKGLVDDEHPVRHPPFIYRDYRKSYGERRAVGKSHLESFYTLKDA

SEQ ID NO: 575 - protein, 380 aa, Selaginella moellendorffii
  misc_feature (1)..(380): Public GI ID no. 302797527
  misc_feature (227)..(323): Pfam Name: 2OG-FeII_Oxy Pfam Description: 2OG-Fe(II) oxygenase superfamily
  misc_feature (1)..(380): Bit score of 246.2 for HMM based on sequences of Figure 1
  misc_feature (1)..(380): Functional Homolog Of SEQ ID NO. 471
MAAAQTLQPASVPSVHNIPISGASTNVGSLAKALQGTETIPEVFLLPESERVTVPHDGYSEQVSLPVVDLGELLLPECSEESRKRIAREVAEASSEWGFFQVAGHGIPLELLERVRTQGRAFFSLPAEDKEKASLGLFQGYEGRHGFIPTRVPWSETFTLLIAPTSNVVPIVEKLWPDGNSELSSTIMDYGNELHCLGVKILELLAESLDLDQDFFSKNFKSKHSAGMRMNFYPPCPQPSMALGLGAHADPNCLTMLYQDEVGGLQIQKDDKWIAVKPDVDSLVLNIGDSLQAWSNGRFRSVQHRAVVNGNNARLSVAFFYSPDDSVSMEVPAQLVDEAHPLLYRPFTWAEYLQQIRTKRMRGKGGLDTFMKISDESKTD

SEQ ID NO: 576 - protein, 366 aa, Physcomitrella patens
  misc_feature (1)..(366): Public GI ID no. 168044400
  misc_feature (1)..(366): Physcomitrella patens subsp. patens
  misc_feature (206)..(301): Pfam Name: 2OG-FeII_Oxy Pfam Description: 2OG-Fe(II) oxygenase superfamily
  misc_feature (1)..(366): Bit score of 254.3 for HMM based on sequences of Figure 1
  misc_feature (1)..(366): Functional Homolog Of SEQ ID NO. 471
MHAGLVSPLPQNSTQLPQEFVEADQKHLSNAELESTEDPELDFPVLDLSLLSGDKKHHDEVITAAAEACQNWGFFQIQNHGIDQRLIEKCKEEALRMFQLPLEAKKRCDRPPGTSFGYGSNTWVNQKVQHWAESFHLQLKPMSNVPAMASKLFPDQTSSQQFSSVVEEYMETVQNLAIQVVEILTEGLGLPPAYFSQHLQRERMVSMRLNFYPPCPEPSKAIGLRAHTDPHLITILHQDTVRGLQVQVAEKWVTVKPRPDCFVVNIGDIFQILSNTRYKSGLHRAVVNGQFQRLSMACFLNLPLDCVVAAPPELITTDCPQKYRPFLWLEYLKHAYLYHPITGNDRHEKFFLKPSGDIPVAASSVH

SEQ ID NO: 577 - protein, 385 aa, Populus simonii
  misc_feature (1)..(385): Public GI ID no. 233142142
  misc_feature (230)..(328): Pfam Name: 2OG-FeII_Oxy Pfam Description: 2OG-Fe(II) oxygenase superfamily
  misc_feature (1)..(385): Bit score of 736.9 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGRVYQDYCEAMSTLSLGIMELLGMSLGVSREYFREFFNENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 578 - protein, 337 aa, Pseudomonas syringae
  misc_feature (1)..(337): Public GI ID no. 330985521
  misc_feature (1)..(337): Pseudomonas syringae pv. lachrymans str. M301315
  misc_feature (185)..(291): Pfam Name: 2OG-FeII_Oxy Pfam Description: 2OG-Fe(II) oxygenase superfamily
  misc_feature (1)..(337): Bit score of 128.5 for HMM based on sequences of Figure 1
  misc_feature (1)..(337): Functional Homolog Of SEQ ID NO. 471
MTLHYVPIINLAPYFSGEPDGKAAVAQAVNQACKDIGFLVITEHQIPKELIDKVSGLTRQFFDLPLAEKRKVDRPSPEMVRGYSAIAEESLSYSLEESAPGDLKESFSIGPSNVPNEDYYHNAEAGSHFAPNVWPAEALLPGFKEAYQAYFEAMSELAQSLMRLFALALELDECFFDDRIDRHISMFRSLSYPDIKTEVEAGQLRASAHTDYGSLTIVRPDNALGGLQVRNQQGEWVDVPYVENGFVVNIGDLMMQWTNDQWISTLHRVVNPPISSEQDNRRQSLVFFHQPNYDTLIECLPGCLLPGTTPRHAPVTSGDHLLAKFVKQTTFGGSKVA

SEQ ID NO: 579 - protein, 377 aa, Vitis vinifera
  misc_feature (1)..(377): Public GI ID no. 225431689
  misc_feature (223)..(320): Pfam Name: 2OG-FeII_Oxy Pfam Description: 2OG-Fe(II) oxygenase superfamily
  misc_feature (1)..(377): Bit score of 507.9 for HMM based on sequences of Figure 1
  misc_feature (1)..(377): Functional Homolog Of SEQ ID NO. 471
MDSSASTILMPPPLELKDERKKGSVVFDSSKMQKQEKLPTEFIWPDADLVRAQQELNEPLIDLDGFFKGDEAATAHAAELIRMACLNHGFFQVTNHGVDLDLIRAAQEDMGAFFKLPLSRKLSVKKKPGELSGYSGAHADRYTSKLPWKETLSFVYCYDSGSKPMVADYFKTALGEDFEQIGWIYQKYCDALKELSLGIMQLLAISLDVDSSYYRKLFEDGYSIMRCNSYPPCKEAGLVMGTGPHCDPVALTILHQDQVKGLEVFVDNKWQSVKPRPGALVVNIGDTFMALSNGKYKSCIHRAVVNMDKERRSLTFFMSPKDDKVVSPPQELIVREGPRKYPDFKWSELLEFTQKHYRPNNDTLQSFVEWRLSSQTK

SEQ ID NO: 580 - protein, 327 aa, Physcomitrella patens
  misc_feature (1)..(327): Public GI ID no. 168015263
  misc_feature (1)..(327): Physcomitrella patens subsp. patens
  misc_feature (178)..(274): Pfam Name: 2OG-FeII_Oxy Pfam Description: 2OG-Fe(II) oxygenase superfamily
  misc_feature (1)..(327): Bit score of 262.0 for HMM based on sequences of Figure 1
  misc_feature (1)..(327): Functional Homolog Of SEQ ID NO. 471
MLEMDGPTLATSASIPIVDMSVLSSSDPAQRASLVANIAEACEKFGFFQVVNHGVDESLIHRCEMEAHKMFELPLDVKERVHRPPGTSFGYGANTWINQTVMHWAESFHMQLHPQSNIKEFSGKLFAESDPTRFSSTVEEYMGQIETLARQLLELLTEGLGLEPTRFNRYVENERMMSMRFNLYPPCPQPELAIGLRAHTDPHLLTILHQDEIAGLQVYIDDEWTTVKPCPDCFVVNVGDLFQVLSNTRYRSVLHRAVVNGTSKRLSLACFLNPPLSAIVEAPPELITTEQPQVYRPFTWEEYLTNAYKFHPAMGGERHERFFLERS

SEQ ID NO: 581 - DNA, 1158 bp, Populus trichocarpa
  misc_feature (1)..(1158): Ceres Annot ID no. 1474270
  misc_feature (1)..(1158): Encodes the peptide sequence at SEQ ID NO. 582
atggcaatagattgcatcaaaaccatgccatccataaccacccctcatcaccacccaaaagatcaggatcaatgcaaagatgatggcaagtcttttgtttttgatgcacaagttcttcgacaccagacaaacataccccagcagttcatttggcctgaccatgaaaagcctaatattaatgcacctgaactccaagtcccacttgtagacttgggtgatttcctctctggtaaccctgttgctgcagtggaagcttcaagacttgttggtgaagcatgtcaaaaacatggtttctttctagttgttaatcatggagttgataaaacgctcattgcccatgctcataattacatggacaccttcttcgaattgccactttctgagaaacaaaaggcccaaagaaagattggcgagtcttgtggatatgctagcagctttactggcaggttttcctctaaacttccatggaaagaaacgctttcttttcgctacacagctgagaagaattcatcaaaacacatcgaggaatactttcataacagaatgggggaagatttcgctgaattcgggagtgtgtatcaggactactgtgaggccatgagcactttgtcactagggatcatggagctattaggcatgagccttggtgtgagcagagaacatttcagggaattctttgatgagaatgattcaataatgaggctcaactactaccctccatgccaaaaacctgaccttactttaggcaccggtcctcattgtgatccaacttctttgaccatccttcatcaagaccaagtgggtggtcttcaagtgtttgtggacaacgaatggcgttcgattagccccaattttgacgcttttgttgttaacattggtgacaccttcatggctctatcgaatggtatatacaagagctgtttgcaccgagcagtggtgaacagccaaacaccaagaaaatccctcgctttctttttgtgtccaaagaatgacaagatggtaactccaccacatgaattagtggacacatgcaatccgagaatatatccagatttcacatggcctatgttgctcgaattcacacaaaagcattaccgagctgacatgaagacacttgaggtgttcacaaactggcttcatcaacaaagttttagctga

SEQ ID NO: 582 - protein, 385 aa, Populus trichocarpa
  misc_feature (1)..(385): Ceres Annot ID no. 1474270
  misc_feature (1)..(385): Public GI ID no. 224136854
  misc_feature (230)..(328): Pfam Name: 2OG-FeII_Oxy Pfam Description: 2OG-Fe(II) oxygenase superfamily
  misc_feature (1)..(385): Bit score of 737.3 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGSVYQDYCEAMSTLSLGIMELLGMSLGVSREHFREFFDENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 583 - protein, 298 aa, Vitis vinifera
  misc_feature (1)..(298): Public GI ID no. 296089115
  misc_feature (173)..(271): Pfam Name: 2OG-FeII_Oxy Pfam Description: 2OG-Fe(II) oxygenase superfamily
  misc_feature (1)..(298): Bit score of 361.0 for HMM based on sequences of Figure 1
  misc_feature (1)..(298): Functional Homolog Of SEQ ID NO. 471
MAMECCTSTMLMPPPRPPLKPLDEANTQHQSLVFDASVLKYQSTIPSQFIWPDEEKPCAKPPELLVPPIDLGGFLSADPLAISNAARLVNEACRKHGFFLVTLSFRYCDDDQSSRIIEKYFSNVMGEDFKQFGRVYQQYCEAMSRLSLGIMELLGMSLGVGREYFREFFEGNDSIMRLNYYPPCQKPNLTLGTGPHCDPTSLTILHQDQVSGLQVFVDEKWHSISPNSEAFVVNIGDTFMALSNGIYKSCLHRAVVNSQTPRKSLAFFLCPKMEKVKHYRADTKTLHVFSNWLQQKNN

SEQ ID NO: 584 - protein, 352 aa, Glycine max
  misc_feature (1)..(352): Public GI ID no. 89574456
  misc_feature (200)..(298): Pfam Name: 2OG-FeII_Oxy Pfam Description: 2OG-Fe(II) oxygenase superfamily
  misc_feature (1)..(352): Bit score of 237.3 for HMM based on sequences of Figure 1
  misc_feature (1)..(352): Functional Homolog Of SEQ ID NO. 471
MGEVDPAFIQEPQHRPNLSTIQAEGIPIIDLSPITNHTVSDPSAIESLVKEIGRACQEWGFFQVTNHGVPLTLRQNIEKASKLFFAQTLEEKRKVSRNESSPMGYYDTEHTKNVRDWKEVFDFLAKDPTFIPLTSDEHDDRVNQWTNQSPQYPPLFRVVTQEYIQEMEKLSFKLLELIALSLGLEAKRFEEFFIKDQTSFIRLNHYPPCPYPDLALGVGRHKDPGALTILAQDEVGGLEVRRKRDQEWIRVKPTPNAYIINIGDTVQVWSNDAYESVDHRVVVNSEKERLSIPFFFFPAHDTKVKPLEELINEQNPSKYRPYNWGKFLVHRGNSNFKKQNEENIQIHHYKIA

SEQ ID NO: 585 - protein, 311 aa, Caulobacter segnis
  misc_feature (1)..(311): Public GI ID no. 295691295
  misc_feature (1)..(311): Caulobacter segnis ATCC 21756
  misc_feature (168)..(269): Pfam Name: 2OG-FeII_Oxy Pfam Description: 2OG-Fe(II) oxygenase superfamily
  misc_feature (1)..(311): Bit score of 77.2 for HMM based on sequences of Figure 1
  misc_feature (1)..(311): Functional Homolog Of SEQ ID NO. 471
MSNSAIAPVSFSLYAKDFTRFSQELGASFERYGFAVLSDYDLDQARIDAAVDAAKAFFALPVETKKQYAGVKGGARGYIPFGVETAKGADHYDLKEFWHMGRELPPGHRFRAHMADNVWPAEIPAFKHDVSWLYNALDGMGGKVLEAIANYLKLDRNFFHPTVQDGNSVLRLLHYPPIPADATGVRAGAHGDINTITLLLGAEEGGLEVLDRDGQWLPINPPPGCLVINIGDMLERLTNHVLPSTVHRVVNPPPERRGFARYSTPFFLHFASDYEIKTLPNCVTAENPDRYPESITADEFLQQRLREIKLA

SEQ ID NO: 586 - protein, 368 aa, Zea mays
  misc_feature (1)..(368): Public GI ID no. 219362733
  misc_feature (200)..(299): Pfam Name: 2OG-FeII_Oxy Pfam Description: 2OG-Fe(II) oxygenase superfamily
  misc_feature (1)..(368): Bit score of 492.4 for HMM based on sequences of Figure 1
  misc_feature (1)..(368): Functional Homolog Of SEQ ID NO. 471
MAAAAVVFDAEALSREEHIPAQFVWPTEERAPAGGVEEVAIPVVDLGEFLRRGVLPRGVAEACERHGVFQVVNHGVGAALLAEAYRCCDAFYALPLADKQRAQRRHGENHGYASSFTGRFHCCLPWKETLSFNCPAGAGTARAVVGYFVDVLGEDYRHMGEVYQEYCDAMTRLALDVTEVLAAALGLDRGALRGFFEGGDSVMRLNHYPACRQPHLTLGTGPHRDPTSLTLLHQDDVGGLQVRAGGGPWRAVRPRADAFVVNIGDTFAALTDGRHTSCLHRAVVTGGGSRRSLAFFLNPPLDRVVRPPGALLQENKQAGRPRAFPDFTWREFLEFTQKHYRSDAGTMDAFVSWIAGGRRHHGGQEEGN

SEQ ID NO: 587 - protein, 417 aa, Vitis vinifera
  misc_feature (1)..(417): Public GI ID no. 147865914
  misc_feature (223)..(289): Pfam Name: 2OG-FeII_Oxy Pfam Description: 2OG-Fe(II) oxygenase superfamily
  misc_feature (1)..(417): Bit score of 363.0 for HMM based on sequences of Figure 1
  misc_feature (1)..(417): Functional Homolog Of SEQ ID NO. 471
MDSSASTILMPPPLELKDERKKGSVVFDSSKMQKQEKLPTEFIWPDADLVRAQQELNEPLIDLDGFFKGDEAATAHAAELIRMACLNHGFFQVTNHGVDLDLIRAAQEDMGAFFKLPLSRKLSVKKKPGELSGYSGAHADRYTSKLPWKETLSFVYCYDSGSKPMVADYFKTALGEDFEQIGWIYQKYCDALKELSLGIMQLLAISLDVDSSYYRKLFEDGYSIMRCNSYPPCKEAGLVMGTGPHCDPVALTILHQDQVKGLEVFVDNKWQSVKPRPGALVVNIGDTFMVGLHLNCPPTYSLLSLPMFLGNNATYDVLRLILVQYERHMALSNGKYKSCIHRAVVNMDKERRSLTFFMSPKDDKVVSPPQELIVREGPRKYPDFKWSELLEFTQKHYRPNNDTLQSFVEWRLSSQTK

SEQ ID NO: 588 - protein, 385 aa, Populus tremula
  misc_feature (1)..(385): Public GI ID no. 53139594
  misc_feature (230)..(328): Pfam Name: 2OG-FeII_Oxy Pfam Description: 2OG-Fe(II) oxygenase superfamily
  misc_feature (1)..(385): Bit score of 734.4 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 589 - protein, 379 aa, Helianthus annuus
  misc_feature (1)..(379): Public GI ID no. 187455576
  misc_feature (224)..(321): Pfam Name: 2OG-FeII_Oxy Pfam Description: 2OG-Fe(II) oxygenase superfamily
  misc_feature (1)..(379): Bit score of 716.1 for HMM based on sequences of Figure 1
  misc_feature (1)..(379): Functional Homolog Of SEQ ID NO. 471
MAIDCIIQNPPTMPSLIEHQQTSLVFDALVLQHETNMPQQFIWPDHEKPNSQKSKELDVPTLDLGGFLSGHSGSVKEACRLVGEACENHGFFLVVNHGVDASLISDAQRYMDLFFELPLSKKLRAQRKVGESCGYASSFTERFSSKLPWKETLSFHFSAEENSYDIVEEYFKSRMGEEFVQLGKVYQDYCNAMSRLSLGIMELLGMSLGVSRSHFKEFFKDNNSIMRLNYYPPCQKPDLTLGTGPHCDPTSLTILHQDKVSGLEVFVENEWRSIAPDSNAFVVNIGDTFMALSNGRYKSCLHRAVVNNKSPRKSLAFFLCPKRDKVVSPPEELVDENNPRVYPDFTWSTFLEFTQKHYRADMNTLQAFSNWVQQKTSRT

SEQ ID NO: 590 - protein, 359 aa, Torenia fournieri
  misc_feature (1)..(359): Public GI ID no. 320462770
  misc_feature (207)..(305): Pfam Name: 2OG-FeII_Oxy Pfam Description: 2OG-Fe(II) oxygenase superfamily
  misc_feature (1)..(359): Bit score of 639.0 for HMM based on sequences of Figure 1
  misc_feature (1)..(359): Functional Homolog Of SEQ ID NO. 471
MPTKESSLSFDASILQHRFNIPPQFIWPDEEKPCPEPPPILDVPPIDLSAFLSKDPNCVANATKLVDKACRKHGFFLVVNHGIDMKLIEEAHMGMELFFKKPIEEKEKALRRPGEHCGYASSFTSRFSEKLPWKETLSFRYSAEEQLSNIVQSYFLDKLGEDNVGFGRVCQEYCEAMSRLSLNVMELLGMSLGVGSSYYRKFFEGNDSIMRLNYYPPCQKPDLVLGTGPHCDPTSLTILHQDDVGGLEVYVDEKWHSITPDPQAFVVNVGDTFMALSNGIYKGCLHRAVVNNKTPRKSLAFFLCPKSDKIVKPPKELVCDENSRTYPDFTWPTLLEFTQKHYRSDMKTFEAFVSWLGNK

SEQ ID NO: 591 - DNA, 1128 bp, Populus trichocarpa
  misc_feature (1)..(1128): Ceres Annot ID no. 1503804
  misc_feature (1)..(1128): Encodes the peptide sequence at SEQ ID NO. 592
atggactcaacctcttcaagtcttctcctgtctcctcctccatttcacagcaaagatgaaactgatgctcctgttctttactcatctttcttgcaaaaacaagccaacatgcccacagagttcatttggcccattggagacttagttcacaaccaagatgagcttaaagagccattgatagacttggatggattcttgaaaggtgatgagcgagcaactgctgatgcggctgagcttgttaggactgcctgcttgaaccacggcttctttcaagtcattaaccatggagttgatataggtctcattcatgctgctcacgaagagattgataaaatttttaagctgcctcttgacaagaaactcagtactcgtaggaagccaggcgatgtgagtggatattctggtgcccatgcacatcgatattcatccaagttgccatggaaggagacattttcttttggctaccatggggatgatgattctgagccacttgttgttgattacttcaaatctgtcttaggagagaactttgaacacacagggtgggtttaccaaagatattgcgaagcaatgaagaaagtatctctagttatttttgagctgctgggcattagcttgggagttgatcgcttacactatcggaaattctttgaagatggaagctcaataatgaggtgcaacaattatccaccttgcaataattctagcctcactcttggcactggtcctcattgtgacccaacttccttaacaatacttcatcaagaccaagttggtggtcttgaagtctttgcaaacaacaaatggcaagcaatccgacctcgtccagatgccctagttgtaaacattggtgatactttcacggcattatccaatgggaggtaccagagctgccttcacagagcagtggtgaatagggagagagaaaggaaatcattggttttctttgtgagtccaaaagaggaaaaggtagtcagacccccacaagatcttgtttgcagagaagggccgaggaagtacccggatttcacttggtcagatttgttggagttcacgcaaaaacactacagagctgatgtcgctacactccaaagcttcattcaatggcttttatctgctaaaccataa

SEQ ID NO: 592 - protein, 375 aa, Populus trichocarpa
  misc_feature (1)..(375): Ceres Annot ID no. 1503804
  misc_feature (1)..(375): Ceres Annot ID no. 1450745
  misc_feature (222)..(319): Pfam Name: 2OG-FeII_Oxy Pfam Description: 2OG-Fe(II) oxygenase superfamily
  misc_feature (1)..(375): Bit score of 530.8 for HMM based on sequences of Figure 1
  misc_feature (1)..(375): Functional Homolog Of SEQ ID NO. 471
MDSTSSSLLLSPPPFHSKDETDAPVLYSSFLQKQANMPTEFIWPIGDLVHNQDELKEPLIDLDGFLKGDERATADAAELVRTACLNHGFFQVINHGVDIGLIHAAHEEIDKIFKLPLDKKLSTRRKPGDVSGYSGAHAHRYSSKLPWKETFSFGYHGDDDSEPLVVDYFKSVLGENFEHTGWVYQRYCEAMKKVSLVIFELLGISLGVDRLHYRKFFEDGSSIMRCNNYPPCNNSSLTLGTGPHCDPTSLTILHQDQVGGLEVFANNKWQAIRPRPDALVVNIGDTFTALSNGRYQSCLHRAVVNRERERKSLVFFVSPKEEKVVRPPQDLVCREGPRKYPDFTWSDLLEFTQKHYRADVATLQSFIQWLLSAKP

SEQ ID NO: 593 - protein, 440 aa, Brassica juncea
  misc_feature (1)..(440): Public GI ID no. 198286468
  misc_feature (301)..(385): Pfam Name: 2OG-FeII_Oxy Pfam Description: 2OG-Fe(II) oxygenase superfamily
  misc_feature (1)..(440): Bit score of 89.9 for HMM based on sequences of Figure 1
  misc_feature (1)..(440): Functional Homolog Of SEQ ID NO. 471
MGSDSTPQLPVIYLSDQTLKPGSEKWVEVRSDVRKALEDYGGFEVSYDRVTEELKKSVLDAMIELFELPVEAKQRNVSPKPYMGYSTHNGLSESLGIQDPNVLEKVNEFTQLLRPDCEGNKSMSETIQKFSEKLVELDVTVKRMVIQSFGIENYFDEHLKSLKNYRMRLMKYVAPPDVDAKDADDGANTNLNANADADAGAGDIANGIANVHIDEDVNAKGDVGTGGGDANHNGDDANTGDSASVKSNVDVGTDVNVKASVGADVNVGTIADANANIGTLSSANVGVGDSVKANGGADDEEKKLGLPSHTDKNLLTVLYQYEIDGLEVLTKDEKWIRLKPAHNSFVVIAGDSLYALMNGRLSRPFHRVRVTERKKTRYSIALFSAPDGDYIIEPPKELVDEKHPRLFKPFTYADLMSFYHTEAGRRSRSTLHAYCAVSGA

SEQ ID NO: 594 - protein, 379 aa, Solanum lycopersicum
  misc_feature (1)..(379): Public GI ID no. 4321498
  misc_feature (226)..(323): Pfam Name: 2OG-FeII_Oxy Pfam Description: 2OG-Fe(II) oxygenase superfamily
  misc_feature (1)..(379): Bit score of 696.8 for HMM based on sequences of Figure 1
  misc_feature (1)..(379): Functional Homolog Of SEQ ID NO. 471
MAIDYMITRNNNMISKEDQVSNKSLSFNASLMKNESNIPSQFIWPDHEKPNYASVTRELQVPLIDLSGVLSNDPIEIKKATRLVNEACTKHGFFLVVNHGVDTNLIKNAHVYIDKFFQLPLCEKQKAQRKVGEHCGYASSFVGRFSSKLPWKETLSFQYSDQKGSSHIVEDYFQRTLGEKFSYIGKVYQEYCNAVSTLSLGIMELLGLSLGVSKNHFKEFFQGNESIMRLNYYPTCQKPELTLGTGPHCDPTSLTILHQDSVGGLQVFVDNEWHTITPNFNAFVVNIGDTFMALSNGRYKSCLHRAVVNNKIPRKSLAFFLCPKKDKVITPPNELVDSNNPRIYPDFTWPTLLEFTQKQYRADMNTLQTFSNWLKKTQS

SEQ ID NO: 595 - protein, 352 aa, Mycobacterium smegmatis
  misc_feature (1)..(352): Public GI ID no. 118470389
  misc_feature (1)..(352): Mycobacterium smegmatis str. MC2 155
  misc_feature (184)..(288): Pfam Name: 2OG-FeII_Oxy Pfam Description: 2OG-Fe(II) oxygenase superfamily
  misc_feature (1)..(352): Bit score of 112.4 for HMM based on sequences of Figure 1
  misc_feature (1)..(352): Functional Homolog Of SEQ ID NO. 471
MSSFRVPAIDISPYVTQGSASSRAAVAEAMDHACSTVGFVQIHGHGIDPGVIAGLTDAADAFFGLPLAEKNRWRRPASENRGYSPPKSESLRLSLDAASTNNMNDFFEAFNVGRSLDDYPNVPDDVRHHYATNTWPDVDGFDSAVWAYFGEAERVATTMTTIFADALHLPVDYFTSRTGHSVNTLRINNYALPEDTRVPTDGELIGMGEHTDYGIVTVLWADQAPGLQILGSDGAWHDVRPDDGALLINLGDLTARLTNERWLSTLHRVRPPVVDGRVQRRRSAAFFFDANADAVIAPHPSFVDASRPALYEPVTVDEHLRAKLADSRIGIPNTAAERESARLHASSSSGAQ

SEQ ID NO: 596 - DNA, 1138 bp, Glycine max
  misc_feature (1)..(1138): Ceres Clone ID no. 539430
  misc_feature (1)..(1138): Encodes the peptide sequence at SEQ ID NO. 597
aaataaaaataacaaagcgatccaaaaaaacacacaaacaacaatcaccatgggagaggaagtagacactgcttttgtccaagcaccagaacacaggccaaaatcctcagtgatcgtggcagaaggaatccctctgattgatctctctcccataaactaccaaaacgaagacaccctcttggattcttctatcgaaaacttagtcaaagaaataggcagtgcttgcaagaaatggggtttctttcaggtgatcaatcacaaggtgcctttggataaacgagagaggattgaagaggctgcaaaaaagttctttgcacttggtttagaggaaaagttgaaggtgagaagggatgcggttaacgtgttgggttactttgaagcagaacataccaagaacgttagggactggaaagagatctatgatttcaatgttcaggaacccacttttataccaccctcagatgaaccagatgatgaggaaaacgttcagttccaatgggataaccggtggcctcagaatcctcctgagttcaaagaagcatgccaagagtatgcacaagaagtggagaaacttgcttataagttgatggaacttgttgcactgagcttaggcttagtgccaaataggttccgcgggtatttcacacataacacgagcaatatccgtctgaatcattatccagcttgcccctaccctcatctggctcttggactcggacgccacaaggacactggtgtcttgactgtgcttgctcaagatgacactggtggtctagaagttaggagaaaatcagatggagagtggattcgagtcaagcccattttcaattccttcatcatcaatgtcggtgatatgatccaggtttggagcaatgatgcttatgagagtgtagaacacagggttatggtgaactctgagaaggataggttttcaattccattctttctgaaaccagcactctacactgatgtgaagcccttggaagagttgctagatgatagaaaccctcctatatatagaccagtcaactggggtaagttccgctctgcaagaatgcgaagtaattttgccaaatccaaagttgaaaacctccaaatttatgatttcaagtttcctagtaactgagtcagagtccat

SEQ ID NO: 597 - protein, 358 aa, Glycine max
  misc_feature (1)..(358): Ceres Clone ID no. 539430
  misc_feature (202)..(302): Pfam Name: 2OG-FeII_Oxy Pfam Description: 2OG-Fe(II) oxygenase superfamily
  misc_feature (1)..(358): Bit score of 205.2 for HMM based on sequences of Figure 1
  misc_feature (1)..(358): Functional Homolog Of SEQ ID NO. 471
MGEEVDTAFVQAPEHRPKSSVIVAEGIPLIDLSPINYQNEDTLLDSSIENLVKEIGSACKKWGFFQVINHKVPLDKRERIEEAAKKFFALGLEEKLKVRRDAVNVLGYFEAEHTKNVRDWKEIYDFNVQEPTFIPPSDEPDDEENVQFQWDNRWPQNPPEFKEACQEYAQEVEKLAYKLMELVALSLGLVPNRFRGYFTHNTSNIRLNHYPACPYPHLALGLGRHKDTGVLTVLAQDDTGGLEVRRKSDGEWIRVKPIFNSFIINVGDMIQVWSNDAYESVEHRVMVNSEKDRFSIPFFLKPALYTDVKPLEELLDDRNPPIYRPVNWGKFRSARMRSNFAKSKVENLQIYDFKFPSN

SEQ ID NO: 598 - DNA, 1263 bp, Glycine max
  misc_feature (1)..(1263): Ceres Clone ID no. 518341
  misc_feature (1)..(1263): Encodes the peptide sequence at SEQ ID NO. 599
atcagcactagcaacagccatgggagaggtagacccagctttcatccaagacctagaacacagaccaaagctctccataatccaagctgaaggaattcccataattgacctctctccaatatccaaccacacagtttcagatccatcttccattgaaaacttagtgaagcagatagggagtgcatgcaaggaatggggtttcttccaagtaaccaaccatggggtgcccctcactctaaggcaaaacattgagaaagcctcaagattgttctttgcacagaatttggaggagaaaagaaaggttagcagagatgagagttctccaaatggttactatgacacagaacacaccaagaacattagggactggaaagaagtctttgattttcaagccaaagaccccactttcatccctgtcacttttgatgaacatgatgatcgagtcactcactggactaatcattctcctcaataccctccaaactttagggatataatcgaagagtatgttcaagaggtggaaaagctgtcctttaagctgttggagattatagctctgagcttaggccttgaggcaaagaggtttgaagagtttttcatcaaagatcaaactagctttattcgactcaaccactatcctccatgcccttcccctcatctagctcttggtgttggtcgacacaaggacattggagccttaaccattcttgcacaagatgatgttggaggacttgaagtcaaacgcaaagcagatcaagagtggataagagtgaaacctacaccaggtgcttatataatcaacgttggtgatcttattcaggtttggagcaatgacttatatgagagtgtggaacacagagcgatggttaactctgagaaagaaaggttttccataccttttttcttattccctgcacactacactgaagtcaagcctttggaggagttgacaaatgaccaaaaccctgcaaaatataggccatacaattggggcaagtttcttgtccgtagaaagggcagcaatttcaagaaactaaatgtggagaatattcagatttatcattataagatagcttaaaaggatggtaaattagcagtgccttttagcctatgcatgtaaaacaaactgattcaagaatgtttctgatatgtgggactgtgatcttatgctgctaaaattactagtgtgcaatgtgcattatgtatgccaggagcatctaataaaagaaaaataaatcaagattaatgatatttgaacacttc

SEQ ID NO: 599 - protein, 352 aa, Glycine max
  misc_feature (1)..(352): Ceres Clone ID no. 518341
  misc_feature (200)..(298): Pfam Name: 2OG-FeII_Oxy Pfam Description: 2OG-Fe(II) oxygenase superfamily
  misc_feature (1)..(352): Bit score of 216.3 for HMM based on sequences of Figure 1
  misc_feature (1)..(352): Functional Homolog Of SEQ ID NO. 471
MGEVDPAFIQDLEHRPKLSIIQAEGIPIIDLSPISNHTVSDPSSIENLVKQIGSACKEWGFFQVTNHGVPLTLRQNIEKASRLFFAQNLEEKRKVSRDESSPNGYYDTEHTKNIRDWKEVFDFQAKDPTFIPVTFDEHDDRVTHWTNHSPQYPPNFRDIIEEYVQEVEKLSFKLLEIIALSLGLEAKRFEEFFIKDQTSFIRLNHYPPCPSPHLALGVGRHKDIGALTILAQDDVGGLEVKRKADQEWIRVKPTPGAYIINVGDLIQVWSNDLYESVEHRAMVNSEKERFSIPFFLFPAHYTEVKPLEELTNDQNPAKYRPYNWGKFLVRRKGSNFKKLNVENIQIYHYKIA

SEQ ID NO: 600 - protein, 353 aa, Glycine max
  misc_feature (1)..(353): Public GI ID no. 89574455
  misc_feature (1)..(353): Ceres Clone ID no. 473822
  misc_feature (200)..(298): Pfam Name: 2OG-FeII_Oxy Pfam Description: 2OG-Fe(II) oxygenase superfamily
  misc_feature (1)..(353): Bit score of 230.6 for HMM based on sequences of Figure 1
  misc_feature (1)..(353): Functional Homolog Of SEQ ID NO. 471
MEKVDQAFIQYPQHRPNLTIIQPEHIPIIDLSPITNHTVSHPSPIEGLVKEIGNACKEWGFFQVINHGVSLTLRQNIEKASKLFFAQSLEEKRKVSRDESSPMGYYDTEHTKNIRDWKEVFDFLAKDPTFVPLTSDEHDNRLTQWTNPSPQYPPHFRDIIKEYVEEMEKLSFKLMELIALNLGLEAKRFEEFFIKDQTSFLRLNYYPPCPYPHLALGVGRHKDSGPLTILAQDEVGGLEVRPKADQDWIRVKPIPNAYIINLGDMIQVWSNDAYESVEHRVVVNSEKARFSIPFFLFPAHDTVVKPLEELINEQNPSKFRPYKWGKFLVHRLDSNFKKQNAENVQTYHYKIRE

SEQ ID NO: 601 - protein, 337 aa, Pseudomonas syringae
  misc_feature (1)..(337): Public GI ID no. 330958505
  misc_feature (1)..(337): Pseudomonas syringae pv. maculicola str. ES4326
  misc_feature (185)..(291): Pfam Name: 2OG-FeII_Oxy Pfam Description: 2OG-Fe(II) oxygenase superfamily
  misc_feature (1)..(337): Bit score of 133.4 for HMM based on sequences of Figure 1
  misc_feature (1)..(337): Functional Homolog Of SEQ ID NO. 471
MTLHYVPIINLAPYFSGTPDGKAAVAQAVNQACKDIGFLVITEHQIPAELIERVSRLTRQFFDLPLAKKRKVDRPSPEMVRGYSAVAEESLSYSLEESAPGDLKESFSIGPSDVPDEDYYHNAVAGPHFAPNVWPAEEQVPGFQQAYREYFEAMSQLAQSLMRLFALALGLDECFFDDKIDRHISMFRSLSYPDIKTEVEAGQLRASAHTDYGSLTIVRPDNALGGLQVRNQQGEWVDVPYVENGFVVNIGDLMMQWTNDQWISTLHRVINPPMTSEQDNRRQSLVFFHQPNYDTLIQCLPGCLQPGATPRHAPVTSGDHLLAKFVKQTTFGGSKVA

SEQ ID NO: 602 - protein, 311 aa, Brevundimonas
  misc_feature (1)..(311): Public GI ID no. 254419812
  misc_feature (1)..(311): Brevundimonas sp. BAL3
  misc_feature (167)..(268): Pfam Name: 2OG-FeII_Oxy Pfam Description: 2OG-Fe(II) oxygenase superfamily
  misc_feature (1)..(311): Bit score of 64.8 for HMM based on sequences of Figure 1
  misc_feature (1)..(311): Functional Homolog Of SEQ ID NO. 471
MRAVTPVSMKRYDADFQGFSDALGASFVEYGFAVVADHALDDARIAAALADAKTFFALPEAVKRQYHQPGTGGARGLTPFGVEAAKGAASVDLKEFWHVGRELPEGHPYRRFMRDNVWPVETPGFKANVYGLYEELDALGRKILKAIARYLDLGDAYFEDKVEMGNSVLRLLHYPPVPADAPGVRAGAHEDINVITLLLGAEEAGLQLKEKDGSWLDIAPPPGALVINIGDMLQRLTNHVLPSTTHRVVNPAPERRGFARYSTPFFLHFNPDFPIETLPSTITPDNPDRYAGKTILAEDYLTERLREIRLL

SEQ ID NO: 603 - DNA, 1086 bp, Populus trichocarpa
  misc_feature (1)..(1086): Ceres Annot ID no. 1452184
  misc_feature (1)..(1086): Encodes the peptide sequence at SEQ ID NO. 604
atggattctcccctaaaattacaagagcaaagcaagggttttttatttgactcagtgttgcacaaacaagctggttttcccaaagaatttctttggccagacttggttagggctcaacaagagctctcggagccactggtggacctggaggggttcttcaaaggggatgaggaggcaacaaaacaggctgctaatataatcaaggatgcatgctcgaggcatggtttctttcaagtgatcaatcatggagtagatcccaatgttattagagacgcagaggattacatggaccatttcttcaggcttccagtttccgagaaacttaaggctcggaggatgccaggcagcttgtgtggttattctggtgctcatgctgatcggtatgcatcaaaacttccatggaaagagacactctcttttcgttaccatgaaaattcttcggatctcgttgtgctagatttcttcaaatctgctcttgggaatgattttgagcaaacaggaatggtatatcaaaaatattgtgaagctatgatggatttatccttcgccatattggaactactggcaatcagcctgggagttgatcgaaaactttacagaaaattctttgaagatggtttctcgatattgagatgtaacttctaccctccttgtcaagagcctggaaatactcttggcacgggaccccattgcgattcaaattcaataaccatacttcaccaagatcaggttggaggcttagaaattttcacaaacaaagtatggcagacaattccaccccttcaaggtgcactcatcatcaatattggtgataccttcacggcattatccaatgggaaatacaagagttgcttgcatcgggcgatggttaacaagcatgagcagaggaaatctttggcattctttctcagtccaagagaagacaaggtggtgagaccaccacaagagcttgtgtgcagtgaagggaaaaggatgtatccagacttcacatggttgaatttgtctcgattcgtacaaaatcactatagagctgatgatagcacacttcaaaacttcaccaactggtcccaatcagtaaatctctag

SEQ ID NO: 604 - protein, 361 aa, Populus trichocarpa
  misc_feature (1)..(361): Ceres Annot ID no. 1452184
  misc_feature (1)..(361): Public GI ID no. 224082364
  misc_feature (208)..(305): Pfam Name: 2OG-FeII_Oxy Pfam Description: 2OG-Fe(II) oxygenase superfamily
  misc_feature (1)..(361): Bit score of 501.5 for HMM based on sequences of Figure 1
  misc_feature (1)..(361): Functional Homolog Of SEQ ID NO. 471
MDSPLKLQEQSKGFLFDSVLHKQAGFPKEFLWPDLVRAQQELSEPLVDLEGFFKGDEEATKQAANIIKDACSRHGFFQVINHGVDPNVIRDAEDYMDHFFRLPVSEKLKARRMPGSLCGYSGAHADRYASKLPWKETLSFRYHENSSDLVVLDFFKSALGNDFEQTGMVYQKYCEAMMDLSFAILELLAISLGVDRKLYRKFFEDGFSILRCNFYPPCQEPGNTLGTGPHCDSNSITILHQDQVGGLEIFTNKVWQTIPPLQGALIINIGDTFTALSNGKYKSCLHRAMVNKHEQRKSLAFFLSPREDKVVRPPQELVCSEGKRMYPDFTWLNLSRFVQNHYRADDSTLQNFTNWSQSVNL

SEQ ID NO: 605 - protein, 348 aa, Synechococcus
  misc_feature (1)..(348): Public GI ID no. 86605411
  misc_feature (1)..(348): Synechococcus sp. JA-3-3Ab
  misc_feature (190)..(294): Pfam Name: 2OG-FeII_Oxy Pfam Description: 2OG-Fe(II) oxygenase superfamily
  misc_feature (1)..(348): Bit score of 94.1 for HMM based on sequences of Figure 1
  misc_feature (1)..(348): Functional Homolog Of SEQ ID NO. 471
MSAMSPVSSFEQAGIPCLDLTPFREGTDPLGVAKAFGAALEEVGFVVITGHGIPEAIIQTAYERARAFFDLPLEQKMEVVTPDRVKNQGYLPIGIESVAATRGAEVPYDLCEALVFNDLFREDPQRPQAGVDPDSGNLWPTHPAGLRAALLAYDAALLQLTQTLMRMGALALDLPETYFLPFMEGKGGVLRAVHYPEQEVEPIPGQLRYGAHSDYGGFTILRQDGAPGGLQVYSKAGEWIDVQAVPNAFVINVGDLLSRWTNDRWRSTLHRVVNPPRSAFGSSRRLSLVYFTAPRDDAWIECLPTCQNAANPPRYAPVQAGEYIRSKLEVSMIGKAGQSSRRSQTRDP

SEQ ID NO: 606 - protein, 303 aa, Asticcacaulis biprosthecum
  misc_feature (1)..(303): Public GI ID no. 329847655
  misc_feature (1)..(303): Asticcacaulis biprosthecum C19
  misc_feature (160)..(261): Pfam Name: 2OG-FeII_Oxy Pfam Description: 2OG-Fe(II) oxygenase superfamily
  misc_feature (1)..(303): Bit score of 98.6 for HMM based on sequences of Figure 1
  misc_feature (1)..(303): Functional Homolog Of SEQ ID NO. 471
MPLALYDSDFDAFSARLGAAFERYGFAVLGDHGVDPALLKRVDVATKAFFALPETVKTSYHRKGQGGARGYTPFGVETAKGYTAHDLKEFYHVGRDLPAGHPYRDHMADNIWPEVQDFHEATYELYTALDNLGKKVLRAIAVYLGLDREFFTPLVKDGNSVLRLLHYPPVNTPGESVRAGAHGDINVITLLLGAEEPGLQLLDRDGQWLPITPPANCIVCNIGDMLSRLTNGVLPSTVHRVVNPAEGRKDFSRYSTPFFLHFESPYVIRTLPNCMSEDRPDQFPEPITAHEFLQQRIREIKLA

SEQ ID NO: 607 - protein, 272 aa, Brassica rapa
  misc_feature (1)..(272): Public GI ID no. 237682458
  misc_feature (1)..(272): Brassica rapa subsp. pekinensis
  misc_feature (133)..(217): Pfam Name: 2OG-FeII_Oxy Pfam Description: 2OG-Fe(II) oxygenase superfamily
  misc_feature (1)..(272): Bit score of 85.7 for HMM based on sequences of Figure 1
  misc_feature (1)..(272): Functional Homolog Of SEQ ID NO. 471
MKYSAPRDVDTNVAAGANDAGDGANTNNNGNTGADVGAGDSASTGDNDKVVASDDANAGADTNDIVVGIANVHIDDDANDVAKANGDVGAGVDANTNDCASVKSSADVDNVNANVSVGTNGDTNANVGADIEEKKLGLPSHTDKNLLTVLYQYEIEGLEVLTKDEKWIRVKPSHNTFVVIAGDSLHALMNGRLFLPFHRVRVTEKKKTRYSIGLFSTPNRDYIIEPPKELVDEQHPRVFKPLTYVDLMSFYHTEVGRRARSTLHAYCAVSGA

SEQ ID NO: 608 - protein, 355 aa, Hordeum vulgare
  misc_feature (1)..(355): Public GI ID no. 49065948
  misc_feature (1)..(355): Hordeum vulgare subsp. vulgare
  misc_feature (199)..(297): Pfam Name: 2OG-FeII_Oxy Pfam Description: 2OG-Fe(II) oxygenase superfamily
  misc_feature (1)..(355): Bit score of 532.9 for HMM based on sequences of Figure 1
  misc_feature (1)..(355): Functional Homolog Of SEQ ID NO. 471
MASLVFDAAVLSRKEDIPPQFIWPADEAPSVDGVEEIVVPVVDLAGFLAGDDAGLNELVAACERHGFFQVVNHGVDPALLAKAYRCCDAFYALPLAEKQRAQRRLGENHGYAGSFVGRFGSKLPWKETMSFNCSAAPESARKVVDYFVGVLGEEYRHMGDVWQEYCNEMTRLALDVTEVLAACLGLDRGALRGFFAGDDSLMRLNHYPPCKKPHLTLGTGPHHDPTALTLLHQDDVGGLEVFTGGAWRAVRPRSDAFVVNIGDTFSALTNGRHVSCLHRAVVNGSLARRSLTFFLNPQLDRPVTPPAELLAIDGRPRVYPDFTWREFLEFTQKHYRSDSRTLDAFVAWINQGHTG

SEQ ID NO: 609 - protein, 354 aa, Ricinus communis
  misc_feature (1)..(354): Public GI ID no. 255558510
  misc_feature (200)..(297): Pfam Name: 2OG-FeII_Oxy Pfam Description: 2OG-Fe(II) oxygenase superfamily
  misc_feature (1)..(354): Bit score of 508.1 for HMM based on sequences of Figure 1
  misc_feature (1)..(354): Functional Homolog Of SEQ ID NO. 471
MQQNVSTAQKQTSSTIPTEFQWPKDDLVGAQQELMEPVVDLEYFLRGDEGETLKAARIIKTACLKHGFFQVVNHGVDLKLIKMANDHMDNFFKLPTSQKLRARKMPGKMWGYSSAHADRFLSKLPWKETLSFGYHENGSDPVVLNFFNSTMGKDFEQMGKVYQKYCEAMKELSLSLMELLAISLGVDRLHYKKFFEDSCSVMRCNFYPICEEPSLVLGTGPHCDPTTLTILHQDQVGGLEVFTNSEWHAVPPRHGALVINVGDTFTALSNGIYKSCLHRAVVNKYEDRKSLAFFLCPKEDKVVRPPQDLVCRERKRMYPDFTWSDLLHFTQDYYRADSATLQNFTNWLLISSNS

SEQ ID NO: 610 - protein, 346 aa, Nocardioidaceae bacterium
  misc_feature (1)..(346): Public GI ID no. 326332772
  misc_feature (1)..(346): Nocardioidaceae bacterium Broad-1
  misc_feature (182)..(286): Pfam Name: 2OG-FeII_Oxy Pfam Description: 2OG-Fe(II) oxygenase superfamily
  misc_feature (1)..(346): Bit score of 120.5 for HMM based on sequences of Figure 1
  misc_feature (1)..(346): Functional Homolog Of SEQ ID NO. 471
MNTFHVPAVDIAAYVQGGTPAEKAAVAAAIDTACREVGFIQILGHGVAPSTAEGLASAMDDFFALPTAEKSRWRRPAAENRGYTPPKSETLALSAGVQSETRMKDFFEAFNVGSSVSDHPEAELVEAHYAENTWPEVPDFQVRIDAWRAEAARVARTMVTVFEDALGLERGAISRLATHPIEVLRMNNYALPEGTRVEVDEDMIGMGEHTDYGIVTILWADQVKGLQVLHGGEWHDVSPADGALLINLGDLTTRLTNEQWLSTLHRVKPPIVGGTIRRRRSAAYFFDGDAEAMIGPLPGFVDDEHPRLYRDVTVDEHIAAKLAGSRAGVLNAAADREAARVLTAGR

SEQ ID NO: 611 - DNA, 1291 bp, Glycine max
  misc_feature (1)..(1291): Ceres Clone ID no. 473318
  misc_feature (1)..(1291): Encodes the peptide sequence at SEQ ID NO. 612
gaatcttaaataagagaacagcccaaaacctttcaaaatacacatgctgcaaattgctcacccaatcaccagccatgggagaggttgacgcagcattcatccaagacccaccacacaggccaaagctctccaccatccaagccgaaggaattcccataattgatctctctccaataaccaaccacagagtttcagacccttctgctattgaaggcttagtgaaggagataggtagtgcatgcaacgagtggggtttcttccaagtaacaaaccatggagtgcccctcactctaaggcaaaacattgagaaagcctcaaaattgttctttgcacagagtgcggaggaaaagagaaaggttagcagaaatgagagctctccagcgggttattatgacacagaacacaccaaaaacgttagggactggaaagaagtctttgattttctagccaaagaacccactttcattcctgtcacttctgatgaacatgatgatcgagtcaatcagtggactaatcaatcccctgaataccctctaaactttagggttgtaacacaagagtatattcaagagatggaaaagctgtcctttaagattttagagcttatagctttgagcttaggccttgaagcaaagaggtttgaagaatttttcatcaaagaccaaactagctttattcgactcaaccactatcctccatgcccttatcctgaccttgctcttggcgtcggtcgacacaaggaccctggtgccttaaccattcttgcacaggatgaggttggaggacttgaagtgagacgtaaagcagatcaagagtggataagagtgaaacccaccccagatgcttatatcatcaacattggtgacactgttcaggtttggagcaatgatgcatatgagagtgtggatcacagagtggtggtcaactctgagaaggaaaggttttccattcctttcttcttcttccctgcacacgacaccgaagttaagcctttggaggagctgataaatgagcaaaacccttcaaaatataggccatacaagtggggcaagtttcttgtccacagagggaacagcaattttaagaagcaaaatgaggagaacattcaaatttatcattacaagatagcttaaagggtaaattgtgtatgatattatcatgatatgaggcagcgttgatccaagacaacgttactgatatgaataagtccgatcaacttcactgctaaatttcctagtgtgccttatgtattgaacaatcactgaataaaagaactaaattattaccattt

SEQ ID NO: 612 - protein, 352 aa, Glycine max
  misc_feature (1)..(352): Ceres Clone ID no. 473318
  misc_feature (200)..(298): Pfam Name: 2OG-FeII_Oxy Pfam Description: 2OG-Fe(II) oxygenase superfamily
  misc_feature (1)..(352): Bit score of 233.1 for HMM based on sequences of Figure 1
  misc_feature (1)..(352): Functional Homolog Of SEQ ID NO. 471
MGEVDAAFIQDPPHRPKLSTIQAEGIPIIDLSPITNHRVSDPSAIEGLVKEIGSACNEWGFFQVTNHGVPLTLRQNIEKASKLFFAQSAEEKRKVSRNESSPAGYYDTEHTKNVRDWKEVFDFLAKEPTFIPVTSDEHDDRVNQWTNQSPEYPLNFRVVTQEYIQEMEKLSFKILELIALSLGLEAKRFEEFFIKDQTSFIRLNHYPPCPYPDLALGVGRHKDPGALTILAQDEVGGLEVRRKADQEWIRVKPTPDAYIINIGDTVQVWSNDAYESVDHRVVVNSEKERFSIPFFFFPAHDTEVKPLEELINEQNPSKYRPYKWGKFLVHRGNSNFKKQNEENIQIYHYKIA

SEQ ID NO: 613 - protein, 366 aa, Picea sitchensis
  misc_feature (1)..(366): Public GI ID no. 116785413
  misc_feature (210)..(307): Pfam Name: 2OG-FeII_Oxy Pfam Description: 2OG-Fe(II) oxygenase superfamily
  misc_feature (1)..(366): Bit score of 229.0 for HMM based on sequences of Figure 1
  misc_feature (1)..(366): Functional Homolog Of SEQ ID NO. 471
MGLDSESEARLGIEAAFIQSPEHRPNAKHCDFTLDQIPLIDLSPLSPTSPPHPTTLDSLVAQIHAACRDWGFFQVINHGVSPHLLHTVQSEAANFFSLPMQEKTKVRRDFDNPLGYYDTELTKNVRDWKEVFDFACRGTIRLPSSFEHESDEIRTSTNQWPQNPPRLREACEKYAEAMEKLSFRLLELISRSLGLPADYFNSKFEEHTSFLRLNHYSPCPVPELALGVGRHKDPGALTVLAQDEVGGLQVKRKDGEWIGVKPIPDSFVINLGDCMQVWSNDKYESVEHRVVVNDKRERFSVPFFLFPSHYVMVGPVPDLVNEKNPSRYKEFSWGKFFKRRRDSNFKNLGTENLQIRHFYISQNSSE

SEQ ID NO: 614 - protein, 413 aa, Penicillium aethiopicum
  misc_feature (1)..(413): Public GI ID no. 297242535
  misc_feature (242)..(340): Pfam Name: 2OG-FeII_Oxy Pfam Description: 2OG-Fe(II) oxygenase superfamily
  misc_feature (1)..(413): Bit score of 70.7 for HMM based on sequences of Figure 1
  misc_feature (1)..(413): Functional Homolog Of SEQ ID NO. 471
MGARSKEARHRWFSRLPPDASSSFLPCKRPKSVAFVLWIRPSCFLRESLPAELSGLPGLPLPPQAPTNTMNCGLPEAALSVIDWGRLKSGDVNEGARLLSACDDQGFFYLDLSSEPSFLHDHKSVLHFMDQYFHQGLADKMKDDRQSDTHGYEPVATSTGALNTLPDYYESLKASRDELHGDGRNLAPAVCDRQDLFLRFSDMMHQMVIAILQELDCQLGFGGDRASFQDFHRKDAESLTTLSMFRYPKQETLDLGVGHNKHTDIGTLTFLLCDQWGLQVLSKDPAGWRFVAPREGHAVINVGDTLRFLSGNRFRSAVHRVIPTQRLQHEDRYSIAYFLRAANDTQFTDSAGRQVSAKQWHDEKFDVFRETHEEQEKMPILTGGMERLENLPGIWCGVRLTDGICHRLGAEDC

SEQ ID NO: 615 - protein, 337 aa, Physcomitrella patens
  misc_feature (1)..(337): Public GI ID no. 195976661
  misc_feature (1)..(337): Physcomitrella patens subsp. patens
  misc_feature (188)..(284): Pfam Name: 2OG-FeII_Oxy Pfam Description: 2OG-Fe(II) oxygenase superfamily
  misc_feature (1)..(337): Bit score of 262.6 for HMM based on sequences of Figure 1
  misc_feature (1)..(337): Functional Homolog Of SEQ ID NO. 471
MFVEAEDQRPMLEMDGPTLATSASIPIVDMSVLSSSDPAQRASLVANIAEACEKFGFFQVVNHGVDESLIHRCEMEAHKMFELPLDVKERVHRPPGTSFGYGANTWINQTVMHWAESFHMQLHPQSNIKEFSGKLFAESDPTRFSSTVEEYMGQIETLARQLLELLTEGLGLEPTRFNRYVENERMMSMRFNLYPPCPQPELAIGLRAHTDPHLLTILHQDEIAGLQVYIDDEWTTVKPCPDCFVVNVGDLFQVLSNTRYRSVLHRAVVNGTSKRLSLACFLNPPLSAIVEAPPELITTEQPQVYRPFTWEEYLTNAYKFHPAMGGERHERFFLERS

SEQ ID NO: 616 - DNA, 1149 bp, Sorghum bicolor
  misc_feature (1)..(1149): Ceres Annot ID no. 8644543
  misc_feature (1)..(1149): Encodes the peptide sequence at SEQ ID NO. 617
atggcggcggcgggcgtggtcgtgttcgacgcggaggtgctgagccgggaggagcggatcccggcgcagttcgtgtggccggccgaggatcgggcgccgtcggcgggcggctgcggcgtggaggagatcgccatccccgtggtggacctcggcgagttcctccgccacggggatcgggagctgccgcgcggcgtggcggaggcgtgcgagcgccacggcttcttccaggtggtgaaccacggcgtccccgccgcgctgctcgccgacgcctaccgctgcctcgacgccttctacgcgcgcccgctcgccgacaagcagcgcgcgcagcggcgccccggggagtcccacggctacgccagcagcttcacgggccgcttccgctcctgcctgccctggaaggagacgctctccttcaactgccccgccggcaccggcggcgacacccagagcgccgccgccgtcgtcgactacttcgtcgacgtcctcggcgaggactaccgccacatgggagaggtgtaccaggagtactccgacgagatggcgcggctagcgatggacgtgacggaggtgctggcggcggcgctgggcctgcgccgcggcgcgctgcgcgggttcttcgacggcggcgactccatcatgcggctgaaccactacccggcgtgccggcagccgcaactgacgctggggacggggccgcaccgggacccgacgtcgctgacgctgctgcaccaggacgacgtgggcgggctgcaggtgtgcgccggcggcggcggtggtggtgagtggcgcgcggtgcggccccgcgcggacgcgttcgtggtcaacatcggcgacaccttcgccgcgctcaccgacgggcgccacgccagctgcctccaccgcgccgtggtcagcggtgaccgcgcccgcaggtcgctcgccttcttcttcaacccgccgctcgaccgcgtcgtccgcccgccggacgcgctcctcctcgaggacgagaagcgccgccgcccgcgcgcgttcccggacttcacgtggcgcgagttcctcgagttcacgcagaagcattaccggtcggacgcgagcaccatggacgccttcgtgtcgtggatcgccggaggacgcggcgatggccatggcggcagacaggagggcaagtga

SEQ ID NO: 617 - protein, 382 aa, Sorghum bicolor
  misc_feature (1)..(382): Ceres Annot ID no. 8644543
  misc_feature (1)..(382): Public GI ID no. 242043040
  misc_feature (210)..(312): Pfam Name: 2OG-FeII_Oxy Pfam Description: 2OG-Fe(II) oxygenase superfamily
  misc_feature (1)..(382): Bit score of 490.7 for HMM based on sequences of Figure 1
  misc_feature (1)..(382): Functional Homolog Of SEQ ID NO. 471
MAAAGVVVFDAEVLSREERIPAQFVWPAEDRAPSAGGCGVEEIAIPVVDLGEFLRHGDRELPRGVAEACERHGFFQVVNHGVPAALLADAYRCLDAFYARPLADKQRAQRRPGESHGYASSFTGRFRSCLPWKETLSFNCPAGTGGDTQSAAAVVDYFVDVLGEDYRHMGEVYQEYSDEMARLAMDVTEVLAAALGLRRGALRGFFDGGDSIMRLNHYPACRQPQLTLGTGPHRDPTSLTLLHQDDVGGLQVCAGGGGGGEWRAVRPRADAFVVNIGDTFAALTDGRHASCLHRAVVSGDRARRSLAFFFNPPLDRVVRPPDALLLEDEKRRRPRAFPDFTWREFLEFTQKHYRSDASTMDAFVSWIAGGRGDGHGGRQEGK

SEQ ID NO: 618 - protein, 296 aa, Solanum lycopersicum
  misc_feature (1)..(296): Public GI ID no. 125486693
  misc_feature (219)..(296): Pfam Name: 2OG-FeII_Oxy Pfam Description: 2OG-Fe(II) oxygenase superfamily
  misc_feature (1)..(296): Bit score of 562.3 for HMM based on sequences of Figure 1
  misc_feature (1)..(296): Functional Homolog Of SEQ ID NO. 471
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSC

SEQ ID NO: 619 - protein, 385 aa, Populus tremula
  misc_feature (1)..(385): Public GI ID no. 53139630
  misc_feature (230)..(328): Pfam Name: 2OG-FeII_Oxy Pfam Description: 2OG-Fe(II) oxygenase superfamily
  misc_feature (1)..(385): Bit score of 730.8 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGHASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 620 - protein, 399 aa, Rumex palustris
  misc_feature (1)..(399): Public GI ID no. 109729787
  misc_feature (221)..(319): Pfam Name: 2OG-FeII_Oxy Pfam Description: 2OG-Fe(II) oxygenase superfamily
  misc_feature (1)..(399): Bit score of 633.8 for HMM based on sequences of Figure 1
  misc_feature (1)..(399): Functional Homolog Of SEQ ID NO. 471
MAIECMHKTDHEVKQGREPLSLVFDSKILRNQASIPKEFIWPDDEKPDHEAAELEVPVIDMEGFCREETKSTNNASKLVQEAFMKHGFFLVKNHGVEAELIKHTHKYMREFFELPLVEKQRVQRKLGEHCGYASSFTTRFSCKLPWKETLSFPYSPEEANNTKVVEEYFNSKMTKDFAHMGKLYQEYCEAMNKLSLRIMELLGLSLGVGRQYFRDYFQGNDSVMRLNYYPPCQEPELALGTGPHCDPTSLTILHQDHVNGLQVFVDGEWRFIYPRFDTFVVNIGDTFMALSNGKYKSCLHRAVVNDTSPRKSLAFFLCPKEDLIVCPPNELVNESSPRVYPDFTWPIFLEFTQKHYRADMNTLLNFSRWVRERNQVQQSDGSSSVCPSIHLSCCNVQIK

SEQ ID NO: 621 - protein, 385 aa, Populus tremula
  misc_feature (1)..(385): Public GI ID no. 53139646
  misc_feature (230)..(328): Pfam Name: 2OG-FeII_Oxy Pfam Description: 2OG-Fe(II) oxygenase superfamily
  misc_feature (1)..(385): Bit score of 733.0 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 622 - protein, 385 aa, Populus tremula
  misc_feature (1)..(385): Public GI ID no. 53139614
  misc_feature (230)..(328): Pfam Name: 2OG-FeII_Oxy Pfam Description: 2OG-Fe(II) oxygenase superfamily
  misc_feature (1)..(385): Bit score of 733.6 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKDDKMVTPPHELVDTCNPRIYPDFTWPMLLEFTQKHYRADMKTLEVFTNWLHQRSLS

SEQ ID NO: 623 - protein, 359 aa, Arabidopsis thaliana
  misc_feature (1)..(359): Public GI ID no. 12320815
  misc_feature (203)..(298): Pfam Name: 2OG-FeII_Oxy Pfam Description: 2OG-Fe(II) oxygenase superfamily
  misc_feature (1)..(359): Bit score of 426.3 for HMM based on sequences of Figure 1
  misc_feature (1)..(359): Functional Homolog Of SEQ ID NO. 471
MNSSDVNFSLLQSQPNVPAEFFWPEKDVAPSEGDLDLPIIDLSGFLNGNEAETQLAAKAVKKACMAHGTFLVVNHGFKSGLAEKALEISSLFFGLSKDEKLRAYRIPGNISGYTAGHSQRFSSNLPWNETLTLAFKKGPPHVVEDFLTSRLGNHRQEIGQVFQEFCDAMNGLVMDLMELLGISMGLKDRTYYRRFFEDGSGIFRCNYYPPCKQPEKALGVGPHNDPTAITVLLQDDVVGLEVFAAGSWQTVRPRPGALVVNVGDTFMALSNGNYRSCYHRAVVNKEKVRRSLVFFSCPREDKIIVPPPELVEGEEASRKYPDFTWAQLQKFTQSGYRVDNTTLHNFSSWLVSNSDKKST

SEQ ID NO: 624 - protein, 318 aa, Chitinophaga pinensis
  misc_feature (1)..(318): Public GI ID no. 256420048
  misc_feature (1)..(318): Chitinophaga pinensis DSM 2588
  misc_feature (175)..(277): Pfam Name: 2OG-FeII_Oxy Pfam Description: 2OG-Fe(II) oxygenase superfamily
  misc_feature (1)..(318): Bit score of 118.9 for HMM based on sequences of Figure 1
  misc_feature (1)..(318): Functional Homolog Of SEQ ID NO. 471
MAITHSIPVVDLAAFTSGDAASKAAFVEQLGKAYEEVGFVAVKNHGISDDLIAKLYKYVQLFFTLPSDIKRSYEIPELAGQRGYTSFGKEHAKGYDAPDLKEFFQFGQTVEDDDPIGAEYPPNVAVKEIPAFTPTFFDAYRGFETSGKALLQAIAIYLGLDEYYFDQFIHNGNSILRAIHYPPITEEPSSAIRAEQHEDINLITLLVGASADGLQILDKQNNWVPVTSLPEQIVVNVGDMLQRLTNNRLKSTTHRVVNPPREMWHTSRYSIPFFLHPKSEMPLNALESCVTAEHPLAYEPITAGEYLDERLREIGLKK

SEQ ID NO: 625 - protein, 361 aa, Ricinus communis
  misc_feature (1)..(361): Public GI ID no. 255583171
  misc_feature (209)..(306): Pfam Name: 2OG-FeII_Oxy Pfam Description: 2OG-Fe(II) oxygenase superfamily
  misc_feature (1)..(361): Bit score of 237.1 for HMM based on sequences of Figure 1
  misc_feature (1)..(361): Functional Homolog Of SEQ ID NO. 471
MASILEEQLVESLSCVGQKLCVRNFIWSEEEWPAIDHNSFANGDDDIPVISLQGVFDERKDQEYDNICQEMVNASAKWGFFKLVDHGIALETIEKFKVHVNEFFALSMEQKMKAARSTNLPLGYSASNPDYGKNLPWAEIIQLLQSQEQVVSFARKVYDDQYQPFSNALMEYMQALDKLGMIILEMLAHGLGLPRDFFLRNFEAKEETILRVNKYPPCPIPEKCLGLGSHSDPHTLTILLQDDVGGLQVLKNDNQWIGVCPVLNSFVINLGDTLEAWTNGNLKSVVHRAVVNKEKSRLSAAYFLSPNSRTIIDSLPQFIDLNTNPRKYRPFTWGDFRKQLLSQKRVVGKTALNRYHISKMQ

SEQ ID NO: 626 - protein, 349 aa, Selaginella moellendorffii
  misc_feature (1)..(349): Public GI ID no. 159902523
  misc_feature (188)..(284): Pfam Name: 2OG-FeII_Oxy Pfam Description: 2OG-Fe(II) oxygenase superfamily
  misc_feature (1)..(349): Bit score of 336.7 for HMM based on sequences of Figure 1
  misc_feature (1)..(349): Functional Homolog Of SEQ ID NO. 471
MNTSCELESYVWPRGDCSLPEHGKFASQQDVPTIDLAGGSKAKVDEIGRACRQSGFFQVVNHGVDHELVNQVHASARQFFEFPSDTKLRAARSAGNSFGFAGKFAGRFKSKCPWKETFSLQYTPNSNIKDYMIKVYTAEQHEQHCARYETYCKAMEKLGRELIELIAQSLELAPDALNSYFDDGFSIFRMNMYPPSEHFPRLLGTGPHTDPCALTILHQDEVGGLQVYNRDETWVTVEPRADAFVISIGDTFQALCNHRYKSAKHRAVIHATRARHSLVFFINPGLDTVIRPIPELVVKSKVDEEQDRERPCVEFNWGQLLEFTQKHYRTDVHTLDAFESYLRKTSQAA

SEQ ID NO: 627 - protein, 372 aa, Citrus sinensis
  misc_feature (1)..(372): Public GI ID no. 213876865
  misc_feature (1)..(372): Citrus sinensis x Citrus trifoliata
  misc_feature (218)..(315): Pfam Name: 2OG-FeII_Oxy Pfam Description: 2OG-Fe(II) oxygenase superfamily
  misc_feature (1)..(372): Bit score of 665.9 for HMM based on sequences of Figure 1
  misc_feature (1)..(372): Functional Homolog Of SEQ ID NO. 471
MSMDCYNSSILPTQEQLLVFDASVLQFQSTIPSQFIWPDGEKPSLELPELVIPPIDLRSFLSGDPFEVDKICQLVDEACKKHGFFLVVNHGVDSMLIKKAHKYMDSFFATQLSKKQKAQRKIGDHCGYSSSFTGRFSNKLPWKETLTFRYRANDENSSTVVEDYFFNVMGQDFRQFGKVYQEYCEAMSSLSLGIMELLGMSLGVGRAHFREFFQGHDSIIRLNYYPPCQKPNLTLGTGPHCDPTSLTILHQDQVGGLQVYVDEQWQSVSPNPDAFVVNIGDTFMALSNGIYKSCLHRAAVNNTTVRKSLAFFLCPKMDKVVTPPNNLVNANNPRIYPDFTWHNLLHFTQNYFRADVKTLNAFSAWLQQHVNI

SEQ ID NO: 628 - protein, 381 aa, Physcomitrella patens
  misc_feature (1)..(381): Public GI ID no. 195976665
  misc_feature (1)..(381): Physcomitrella patens subsp. patens
  misc_feature (232)..(328): Pfam Name: 2OG-FeII_Oxy Pfam Description: 2OG-Fe(II) oxygenase superfamily
  misc_feature (1)..(381): Bit score of 254.5 for HMM based on sequences of Figure 1
  misc_feature (1)..(381): Functional Homolog Of SEQ ID NO. 471
MAAHPISSHSHNAADLAAVLTNTNTTLRNASLLSALALVQQLPAMFVEAEDQRPVLEMDGDPLAFSHLIPIVDMSLLKSSDPAVRASPVADIAAACEKFGFFQVVNHGVDESLIRRCETEAHTMFELPLDVKERVHRPPGTSFGYGANTWVNQTVMHWAESFHMQLHPKSNIREFSGKLFAESDPTKFSSTVEEYMGQIEKLARQLLELLTEGLGLEPTTFNHYVENERMMSMRFNLYPPCPQPELAIGLRAHTDPHLLTILHQDEVAGLQVHIDEKWITVKPRPDCFVVNVGDLFQVLSNTRYKSVLHRAAVNGTSKRLSLACFLNPPLSATVEAPPELITAERPQVYRPFTWGEYLSNAYKFHPAMGGERHERFFLERS

SEQ ID NO: 629 - protein, 379 aa, Marah macrocarpus
  misc_feature (1)..(379): Public GI ID no. 1666094
  misc_feature (217)..(315): Pfam Name: 2OG-FeII_Oxy Pfam Description: 2OG-Fe(II) oxygenase superfamily
  misc_feature (1)..(379): Bit score of 565.0 for HMM based on sequences of Figure 1
  misc_feature (1)..(379): Functional Homolog Of SEQ ID NO. 471
MAITCMMATESSPAEEVKREHQVAFGGAGESSVPENFIWPDEFKATADAPELHVPHIDLKKVLSGDEKDVEEATRLVDEACRKHGFFVVVNHGVDKELMNKVHECMNEFFTLPLDVKQKAHRKVGENFGYANSFIGRFSTKLPWKETFSLRYLAHENSSTARDYVSQVLGPEFSHHGEVYQECGKALSDLSLRIVELLGLSLGISRETFRKFYEDNDSIMRMNYYPRCEKPELTLGTGPHCDPTSITILHQDDVSGLQVYVDDQWHSIPPTEDSFVVNVGDTFMSLTNGVYKSCFHRAVVNCKEARKSMAFFLCPAVEKVVRAPEELVEKYPPRKFPDYTWPMLLEMTQKYYRADSNTFNAFTTWIQQQNLDSTASPAV

SEQ ID NO: 630 - protein, 385 aa, Populus tremula
  misc_feature (1)..(385): Public GI ID no. 9650811
  misc_feature (230)..(328): Pfam Name: 2OG-FeII_Oxy Pfam Description: 2OG-Fe(II) oxygenase superfamily
  misc_feature (1)..(385): Bit score of 734.3 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 631 - protein, 370 aa, Phaseolus vulgaris
  misc_feature (1)..(370): Public GI ID no. 2108434
  misc_feature (216)..(314): Pfam Name: 2OG-FeII_Oxy Pfam Description: 2OG-Fe(II) oxygenase superfamily
  misc_feature (1)..(370): Bit score of 601.7 for HMM based on sequences of Figure 1
  misc_feature (1)..(370): Functional Homolog Of SEQ ID NO. 471
MLIPHPSMLLASQNTNMEPQQINLQAPTPNQSNIPSEFVWPDNEKPCLEPPKLKIPPIDMKGFLSGDPETVSAICAEVNAACRKHGFFLVVNHGVDKKLVEKAHKLIDTFFCMELPEKQKLQRKLGEHCGYANSFIGRFSSKLPWKETLSFHYAPDTKTVEDYFLNSMGEEFREFGSFFQEYCEVMSNLSLEIMELLGMSLGVSRECFRDFFKNNESVMRLNYYPPCHKPELALGTGPHCDPTSLTVLHQDQVEGLQVFVDGKWCSVAPKEDAFVVNIGDTFMALSNGIFKSCLHRAVVNNQIVRKSLAFFLCPNKDKVVSAPKELITVENPKKYPDFTWPNLLEFTQLHYRSDPETLDAFANWVLEKNK

SEQ ID NO: 632 - protein, 311 aa, Caulobacter
  misc_feature (1)..(311): Public GI ID no. 167644154
  misc_feature (1)..(311): Caulobacter sp. K31
  misc_feature (168)..(269): Pfam Name: 2OG-FeII_Oxy Pfam Description: 2OG-Fe(II) oxygenase superfamily
  misc_feature (1)..(311): Bit score of 77.8 for HMM based on sequences of Figure 1
  misc_feature (1)..(311): Functional Homolog Of SEQ ID NO. 471
MSASAIEPVSFTLYAKDFDRFAQELGASFQRYGFAVISDHDMAQARIDAAIADAKAFFALPEEIKKQYAGTSGGARGYIPFGIETAKGATHYDLKEFWHVGRDLPPGHPFRATMADNVWPAEIPSFHHNVGWLYGALDSLGVRVLKAIAQYLNLGRDFFDPTVKDGNSVLRLLHYPPIPKDATGVRAGAHGDINTITLLMGAEEGGLEVLDRDGAWLPINPPPGCVVCNIGDMLERLTNHVLPSTIHRVVNPPPERRGVPRYSTPFFLHFASDYLIKTLPNCITEENPDRYPEPITADAFLQQRLREIKLA

SEQ ID NO: 633 - protein, 332 aa, Nectria haematococca
  misc_feature (1)..(332): Public GI ID no. 302882991
  misc_feature (1)..(332): Nectria haematococca mpVI 77-13-4
  misc_feature (180)..(279): Pfam Name: 2OG-FeII_Oxy Pfam Description: 2OG-Fe(II) oxygenase superfamily
  misc_feature (1)..(332): Bit score of 40.9 for HMM based on sequences of Figure 1
  misc_feature (1)..(332): Functional Homolog Of SEQ ID NO. 471
MALVTPSSPYDNVNTADLYTVKFDNLFDGDEQELTTLLKACERDGFFYLDLQGSGSGKLWKDLDRVGEIAKRWFAQPAEVKLETPTLSLAHGFKATGNQSGAVESLRDGFEALKIGRNELLGRWALPSVVQDNLPLFDQFNASCHFILKLLLDCLSDGLNLKGSARLDTYHRDDARSKSTLYFLHYPPGTENLEEVGQNMHTDIGTLTLLFAPQWGLQVVSPVTGAWEYVKPRPGHAIINVADTLRFLSNKRFRSALHRVLPLGGIQQEDRYAVSYFLRASDATEFKDSNDKESNAKNWYLTKYETYELPHDIQGKETVLSGGMAQELRVTF

SEQ ID NO: 634 - protein, 382 aa, Acacia mangium
  misc_feature (1)..(382): Public GI ID no. 160623443
  misc_feature (229)..(326): Pfam Name: 2OG-FeII_Oxy Pfam Description: 2OG-Fe(II) oxygenase superfamily
  misc_feature (1)..(382): Bit score of 702.6 for HMM based on sequences of Figure 1
  misc_feature (1)..(382): Functional Homolog Of SEQ ID NO. 471
MVVECITNNLPSMPHPAKHGTKEDKEDEPLVFDASLLRYEHNLPKQFIWPDEEKPCLNPPELVVPLVDLRGFLSGDPVAAMETSKLVSEACRKHGFFLVVNHGIDSRLISHAHRFMDDFFELPLSQKQRAQRKTGEHCGYASSFTSRFSSKLPWKETLSFQFSADKNSQNLVKDYLCEKVGHEFEQFGMVYQEYCEAMSNLSLVIMELLGMSLGVGRTCFREFFDKNNSIMRLNYYPPCQKPDLTLGTGPHCDPTSLTILHQDKVGGLQVYVDNEWHSITPNFNAFVVNIGDTFMALSNGRYKSCLHRAVVNSQTTRKSLAFFLCPGDDKVVTPPSELVDHVSPRIYPDFTWPMLLEFTQKHYRADMNTLEQFANWVQRNKS

SEQ ID NO: 635 - protein, 314 aa, Kitasatospora setae
  misc_feature (1)..(314): Public GI ID no. 311899282
  misc_feature (1)..(314): Kitasatospora setae KM-6054
  misc_feature (186)..(264): Pfam Name: 2OG-FeII_Oxy Pfam Description: 2OG-Fe(II) oxygenase superfamily
  misc_feature (1)..(314): Bit score of 69.3 for HMM based on sequences of Figure 1
  misc_feature (1)..(314): Functional Homolog Of SEQ ID NO. 471
MLREIDLRAPGDHAHLRAALRDGFFLVRNTVPDGLLDEAYGLLGDFFRLPAEQKAACQVPGSNGQSGYLPPLVETAEKGAAPDWKELFHWGAALPAAHPLRERYPARYREPYFPDHLVPGIGKALTELHTRMREFQLDVVRVLAEPLGVHPDYFTEMLEDGPVVNRATWYPPMDLAPTGQHVWAVEHQDFDLITALPRATAAGLEVLVDGEWLAVDVPEGHAVVNVGMVLDRLTGGLARAAVHRVVAAPGQRGGRLSIVQFCHPTPWTVLTPLAVAGAEGRPQRYPTLTAGDLFQRTMYRINRLDTQRAPAARP

SEQ ID NO: 636 - protein, 568 aa, Oryza sativa
  misc_feature (1)..(568): Public GI ID no. 125572881
  misc_feature (1)..(568): Oryza sativa Japonica Group
  misc_feature (406)..(503): Pfam Name: 2OG-FeII_Oxy Pfam Description: 2OG-Fe(II) oxygenase superfamily
  misc_feature (1)..(568): Bit score of 431.3 for HMM based on sequences of Figure 1
  misc_feature (1)..(568): Functional Homolog Of SEQ ID NO. 471
MDSTAGSGIAAPAAAAVCDLRMEPKIPEPFVWPNGDARPASAAELDMPVVDVGVLRDGDAEGLRRAAAQVAAACATHGFFQVSEHGVDAALGAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMVSEHGVDAALGRAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 637 - protein, 385 aa, Populus tremula
  misc_feature (1)..(385): Public GI ID no. 53139590
  misc_feature (230)..(328): Pfam Name: 2OG-FeII_Oxy Pfam Description: 2OG-Fe(II) oxygenase superfamily
  misc_feature (1)..(385): Bit score of 730.8 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQEHYRADMKTLEVFTNWLHQRSFS

SEQ ID NO: 638 - protein, 362 aa, Neotyphodium uncinatum
  misc_feature (1)..(362): Public GI ID no. 55978167
  misc_feature (216)..(309): Pfam Name: 2OG-FeII_Oxy Pfam Description: 2OG-Fe(II) oxygenase superfamily
  misc_feature (1)..(362): Bit score of 41.3 for HMM based on sequences of Figure 1
  misc_feature (1)..(362): Functional Homolog Of SEQ ID NO. 471
MTVTNKPVKPANVPVMDFEAIHASVGNERKKYLRQLDEAWSHHGAIYVINHSIGTRTLEEAFAWCKKFFDLPLAVKNSVHIPPDVSKHFQGWTGTGEAISSQGVWDPDEIERLRKETPTELKEAMELQDPCGTYPPGAPDLNLVEQHLPGFLDFLKKWFAACYKQSLQNMRLVCEILGMEDLDYIGKKFEPRHMSTHSTWNYFLGQPVSQLASGSANRLNAHTDYCQFTMLFQDMVGGLELHDYEEDIYRPVPPIKGAMIVQVGDLLEKQTNGRWRSALHRVTAPSRYMYEGSAGDDDELVQRYSLVFFGHLNLDEMIEPLPGCEKQGKWSTLEWKDRMTAGQWLARRVALEYERKTAATVM

SEQ ID NO: 639 - protein, 334 aa, Pseudonocardia dioxanivorans
  misc_feature (1)..(334): Public GI ID no. 331699132
  misc_feature (1)..(334): Pseudonocardia dioxanivorans CB1190
  misc_feature (184)..(290): Pfam Name: 2OG-FeII_Oxy Pfam Description: 2OG-Fe(II) oxygenase superfamily
  misc_feature (1)..(334): Bit score of 94.3 for HMM based on sequences of Figure 1
  misc_feature (1)..(334): Functional Homolog Of SEQ ID NO. 471
MTLMSVPVIDISPFRSGTPAQKAEVAAQVAQACTDIGFLVISGHGIADDLISRMYRATKSFFEGPLENKLAVARPEAGQIRGYSGVEQEGLGLLEDQPAPPDLKESYDIGPLDAPADDYHQAEAAGAHFAPNVWPTGVEDFEPAYRAYYQAMEGLTLEMLEIFASALDLPHDYFVDKVDKHISILRTNYYPPQLTEPKPNQIRGGAHSDYTAMTILWQEDVEGGGLQVENKAGEWVDVPVVPGTFVVNLGDSLERWTNDRWVSTMHRVVNPPHEIARTQSRISIPYFVQPNYDAVIECIPTCFDDENPAKYEPMRNGEYLYMKFTQQNTLAAAE

SEQ ID NO: 640 - protein, 320 aa, Pedobacter saltans
  misc_feature (1)..(320): Public GI ID no. 325106136
  misc_feature (1)..(320): Pedobacter saltans DSM 12145
  misc_feature (192)..(279): Pfam Name: 2OG-FeII_Oxy Pfam Description: 2OG-Fe(II) oxygenase superfamily
  misc_feature (1)..(320): Bit score of 122.0 for HMM based on sequences of Figure 1
  misc_feature (1)..(320): Functional Homolog Of SEQ ID NO. 471
MTSINIPRLDLSKYTEGTTSEKKQFSDDIGKAFNETGFVTITNHGLSKELISSLYEQVKAFFALPEDTKLKYQKVELAGQRGYTSKGREKAKDAKTPDLKEFWQTGQYVQGEDVVKDEYPDNLIVEEVPEFNVVTKEIYKKLETAGKSILNAISVYLGLPEDYFEDKVYNGNSILRAIHYFPIENPDALPADAVRAGAHEDINLITLLIGASADGLEVLTRDGEWFPIKAHGEDIVVNVGDMLQRLTNNKLKSTTHRVVNPPRELMKNSRYSVPFFLHPKAKMDLTCLDSCVDSQHPKAYTDITAGEYLDERLREIGLKM

SEQ ID NO: 641 - protein, 385 aa, Populus tremula
  misc_feature (1)..(385): Public GI ID no. 53139664
  misc_feature (230)..(328): Pfam Name: 2OG-FeII_Oxy Pfam Description: 2OG-Fe(II) oxygenase superfamily
  misc_feature (1)..(385): Bit score of 733.8 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGVYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 642 - DNA, 1346 bp, Panicum virgatum
  misc_feature (1)..(1346): Ceres Clone ID no. 1827193
  misc_feature (1)..(1346): Encodes the peptide sequence at SEQ ID NO. 643
gagctgcactgcacgcagcctcctggccaagatcacgacgcagctcatctgtcgcaggctcgcagcgtcagacttacctcgaccgcaggaaaacttgatccaatccaacgccatgggcggcctctccatgggccaggccttcgtgcaggcccccgagcaccgccccaagcccaccgtcaccgaggccaccggcatcccgctcatcgacctctcgccgctcaccaccggcgaggccgccgccgtggacgcgctggccgccgaggtgggcgcggcgagccgcgagtggggcttcttcgtggtggtgggccacggcgtgccggcggaggccgtggcgcgcgcgacggaggcgcagcgcgcgttcttcgcgctcccggccgagcgcaaggccgccgtgcggaggagcgaggcggagccgctcgggtactacgagtcggagcacaccaagaacgtcagggactggaaggaggtgttcgacctcgtcccgcgcgagccgcagcggccggcagccgtggccgacggcgagctcgtgttcgccaacaagtggcctcaagacctgccgggattcagagaggcgctggaggagtacgcggaagcaatggaggagctggcgttcaagatactggagctgatcgcccggagcctgaacctgaggcccgaccggcagcacggcttcttcagggaccagaccaccttcatccggctcaaccactaccccccccccccctgcccgagccccgacctcgccctcggcgtggggcggcacaaggacgccggagccctgaccgtcctgtaccaggacgacgtcggcgggctcgacgtccggcggcgctccgacggggagtgggtccgcgtcaagcctgtccccaactccttcatcatcaacgtcggcgacatcatccaggtgtggagcaacgacaggtacgagagcgcggagcaccgggtgtcggtgaactcggccagggagcggttctccatgccctacttcttcaacccggcgagctacaccatggtggagcccgtggaggagctggtgagcgaggaggccccgccccggtacaacgcctacaactggggcgacttcttcagcaccaggaagaacagcaactacaagaagctggacgtggagaacatccagatcgcccatttcaagaagagcgtcgccgccgcctaggacatgaaggcatcacctagctacctcgccgcctaagaaagaaataatgtgcgtgtgcgcttgtaataatcgtggtgtgagatgtgacgagtactctgacgtgtttgaaaataacagccctgtgttggcctggttatctgcaaaaatcaaaactttcttgaagaaagtttcttct

SEQ ID NO: 643 - protein, 352 aa, Panicum virgatum
  misc_feature (1)..(352): Ceres Clone ID no. 1827193
  misc_feature (195)..(294): Pfam Name: 2OG-FeII_Oxy Pfam Description: 2OG-Fe(II) oxygenase superfamily
  misc_feature (1)..(352): Bit score of 208.6 for HMM based on sequences of Figure 1
  misc_feature (1)..(352): Functional Homolog Of SEQ ID NO. 471
MGGLSMGQAFVQAPEHRPKPTVTEATGIPLIDLSPLTTGEAAAVDALAAEVGAASREWGFFVVVGHGVPAEAVARATEAQRAFFALPAERKAAVRRSEAEPLGYYESEHTKNVRDWKEVFDLVPREPQRPAAVADGELVFANKWPQDLPGFREALEEYAEAMEELAFKILELIARSLNLRPDRQHGFFRDQTTFIRLNHYPPPPCPSPDLALGVGRHKDAGALTVLYQDDVGGLDVRRRSDGEWVRVKPVPNSFIINVGDIIQVWSNDRYESAEHRVSVNSARERFSMPYFFNPASYTMVEPVEELVSEEAPPRYNAYNWGDFFSTRKNSNYKKLDVENIQIAHFKKSVAAA

SEQ ID NO: 644 - protein, 382 aa, Acacia mangium
  misc_feature (1)..(382): Public GI ID no. 160623445
  misc_feature (229)..(326): Pfam Name: 2OG-FeII_Oxy Pfam Description: 2OG-Fe(II) oxygenase superfamily
  misc_feature (1)..(382): Bit score of 698.7 for HMM based on sequences of Figure 1
  misc_feature (1)..(382): Functional Homolog Of SEQ ID NO. 471
MVVECITNNLPSMPHPAKHGTKEDKEDEPLVFDASLLRYEHNLPKQFIWPDEEKPCLNPPELVVPLVDLRGFLSGDPVAAMETSKLVSEACRKHGFFLVVNHRIDSRLISHAHRFMDDFFELPLSQKQRAQRKAGEHCGYASSFTSRFSSKLPWKETLSFQFSADKNSQNLVKDYLCEKVGHEFEQFGMVYQEYCEAMSNLSLVIMELLGMSLGVGRTCFREFFDKNNSIMRLNYYPPCQKPDLTLGTGPHCDPTSLTILHQDKVGGLQVYVDNEWHSITPNFNAFVVNIGDTFMALSNGRYKSCLHRAVVNSQTTRKSLAFFLCPGDDKVVTPPSELVDHVSPRIYPDFTWPMLLEFTQKHYRADMNTLEQFANWVQRNKS

SEQ ID NO: 645 - protein, 272 aa, Aspergillus niger
  misc_feature (1)..(272): Public GI ID no. 134075373
  misc_feature (131)..(214): Pfam Name: 2OG-FeII_Oxy Pfam Description: 2OG-Fe(II) oxygenase superfamily
  misc_feature (1)..(272): Bit score of 47.4 for HMM based on sequences of Figure 1
  misc_feature (1)..(272): Functional Homolog Of SEQ ID NO. 471
MPTSKYFDRIPPFPSDMPVVSLAKVSLEALKDNRGSEVKKLYEAVKNGVLHVDYHSRLHPDVISISQEQIRQFIEHAHAVLDEVLAKLDTCLGIESQTLEALSPLDQESDGIVRLLWSPAQTNPNYDRILFGGHTDMGTMTLLFNIAGGLQVLPAGCENCKENWRYIKPEPGCAVVNVGDTLVEWTGGLLRSSLHRVVTAPGDQAMVQRHSVAYLVRAKRNASLQRLKGGTIPPLAPGEEDETRSVDEWNEWKSRQIVLGQLKPETRGGRNM

SEQ ID NO: 646 - protein, 378 aa, Gossypium hirsutum
  misc_feature (1)..(378): Public GI ID no. 222875436
  misc_feature (220)..(317): Pfam Name: 2OG-FeII_Oxy Pfam Description: 2OG-Fe(II) oxygenase superfamily
  misc_feature (1)..(378): Bit score of 513.6 for HMM based on sequences of Figure 1
  misc_feature (1)..(378): Functional Homolog Of SEQ ID NO. 471
MDSGSPTIHLHPSIEPRDETGGVLFDPSKLQNQSSLPSEFIWPCGDLVHAQEELNEPLIDLGGFIKGDEKATAHAVGLVKTACSKHGFFQVTNHGVDSNLIQAAYQGIDAVFKLPLNKKLSFQRKPGGFSGYSAAHADRFSAKLPWEETFSFGYQGLNSDPSVVHYFSSALGEDFEQTGWIYQKYCEKMRELSLLIFELLAISLGIDRLHYRKFFEDGNSIMRCNYYPPCNNSGLTLGTGPHSDPTSLTILHQDQVGGLEVFNNNKWYAVRPRQDAFVINIGDTFMALCNGRYKSCLHRAVVNKERERRSLVCFVCPKEDKIVRPPQDLMCRSGGPRVYPDFTWSDLLEFTQNHYRADVATLQSFFPWLLSSNPTSNF

SEQ ID NO: 647 - protein, 386 aa, Cucurbita maxima
  misc_feature (1)..(386): Public GI ID no. 2224890
  misc_feature (220)..(318): Pfam Name: 2OG-FeII_Oxy Pfam Description: 2OG-Fe(II) oxygenase superfamily
  misc_feature (1)..(386): Bit score of 494.4 for HMM based on sequences of Figure 1
  misc_feature (1)..(386): Functional Homolog Of SEQ ID NO. 471
MALNGKVATESAPSNLNEEMKGEYRPPFGGSDESKVPEDFIWSEKFEASELLPVLDVPTIDLEKFMSGDKSYVEEATRLVDEACRQHGIFFVVNHGVDIEMMGRVHDCMNEFFTMPLDVKQRAKRKVGESYGYTNSFFGRFASNLPWKETFSLRCVAAQNSSAAHDYVLDTLGSSFSHHGKAYQECGIALNELGTKIVELLGLSLGISREYFKNFYKDNDSILRLNYYPTCDKPEVVLGTGPHTDPTSVTILHQDPVSGLQVCSNDQWYSIPPNPEAFVINIGDTFTSLTNGIYKGCIHRAVVNSMNARKSLAFFLCPSHDKVVRAPEELVEKSPPRKYPDYKWPMLLEMTQKRYRPACNTLEAFKTWVQEGKALDTGSTITAPSA

SEQ ID NO: 648 - protein, 356 aa, Rhodococcus erythropolis
  misc_feature (1)..(356): Public GI ID no. 226305722
  misc_feature (1)..(356): Rhodococcus erythropolis PR4
  misc_feature (194)..(298): Pfam Name: 2OG-FeII_Oxy Pfam Description: 2OG-Fe(II) oxygenase superfamily
  misc_feature (1)..(356): Bit score of 101.4 for HMM based on sequences of Figure 1
  misc_feature (1)..(356): Functional Homolog Of SEQ ID NO. 471
MTHEIPAFEIPTIDISPYLTGEASAANATNSTACAEVAAQLDRACREVGFIQIVGHSIPRSATDGLADALDEFFALPLTVKNNYRRPSSENRGYSPPKSESLSMSLGVAAANQMNDFYEAIVVGTEVSDYPGVDLPESSYAANTWPEAAPGFRPAIEEYFRHAQGLARILMCAFTDALGLPPEYFDSMLDHSIDAMKMNNYALPEGEIRISGDMTGMGAHTDFGILTILWADQVPGLQVLSADGVWHDVQPADGALLINLGDAMARWTNDRWRSTVHRVDPPIVDGQIIRRRSAAFFFDGNYDAVIEALPGTLEPGEVGYPPITIAENIAAKVAGLKGATAPDVDSRSADRVRAAG

SEQ ID NO: 649 - protein, 383 aa, Daucus carota
  misc_feature (1)..(383): Public GI ID no. 50428327
  misc_feature (219)..(316): Pfam Name: 2OG-FeII_Oxy Pfam Description: 2OG-Fe(II) oxygenase superfamily
  misc_feature (1)..(383): Bit score of 676.4 for HMM based on sequences of Figure 1
  misc_feature (1)..(383): Functional Homolog Of SEQ ID NO. 471
MAASTFLYHRHQQPFYPKSLVFDPSIIKNELNIPQEFIWPDHEKPSSHTPQLDVPLVDVGGFLSGDPVAAEKASKLVGQACREHGFFLVTNHGVDGNLISDAHKSMDLFFELPLMEKQKAQRKLGEHCGYASSFTGRFSSKLPWKETLSFEHSTKKTSSTLVEDYFASALGKDYAKLGKVYQDYCNAMSRLSFGIMELLAISLGIDRSHFKNFFEENNSIMRLNYYPTCRRPELTLGTGPHCDPTSLTILHQDDVGGLEVFVDNQWQSIPPNPSSFVVNLGDTFMALSNGKYKSCLHRAVVNKQNPRRSLAFFLCPQKDKVVRPPTELVDQDNPRLYPDFTWSALLEFTQKHYRADMNTLQAFSSWLTTFNNKEHLGEGHVIN

SEQ ID NO: 650 - protein, 360 aa, Selaginella moellendorffii
  misc_feature (1)..(360): Public GI ID no. 302797040
  misc_feature (210)..(307): Pfam Name: 2OG-FeII_Oxy Pfam Description: 2OG-Fe(II) oxygenase superfamily
  misc_feature (1)..(360): Bit score of 232.4 for HMM based on sequences of Figure 1
  misc_feature (1)..(360): Functional Homolog Of SEQ ID NO. 471
MAPTQGGTQGGVDYKLTTFLQGSLTLDDYVWSQEEWPKVAYNDYNDEDTVPIIDISLLRSEDAATRSKGLKDLMEAAREWGFFRLVNHGVLSDVTEKLESDGKELFALPLEQKKKAVRLPESIIGYYFGAESVFSKAWLEAFHFSGDKEVTDNMIRQVSPENFNELSASVHNYIDAYQKLAIEVVELMAIALGLEPSTFSKYTATKGDKSTVRVCYYPPCPQPQQTLGQRPHADPILITIVHQDDVGGLQILKNNRWIAVKPEPGTVVVNVGDTLQVLSNDIYPSVQHQVVLNSERSRLSMAFFLIPEANALIVPAKGLVDDEHPVRHPPFIYRDYRKSYGERRAVGKSHLESFYTLKDA

SEQ ID NO: 651 - protein, 384 aa, Musa acuminata
  misc_feature (1)..(384): Public GI ID no. 104295012
  misc_feature (220)..(317): Pfam Name: 2OG-FeII_Oxy Pfam Description: 2OG-Fe(II) oxygenase superfamily
  misc_feature (1)..(384): Bit score of 500.9 for HMM based on sequences of Figure 1
  misc_feature (1)..(384): Functional Homolog Of SEQ ID NO. 471
MDSVSPVTLDLNKEEGHCSNGAVVFDTSFLRRQAKIPESFVWPRNERPHPLEELEVPVVDLRGLFEGDEASISRAAEASRAACVRHGFFQVINHKVDAKVSGDALDAAGDFFKLPLSTKLRARRQPGSAWGYVGAHADRFASKLPWKETLTFGYDYGERGDGVVDYFTSKLGEGFEPMGRVYRRYCEAMKELSLSIMELLGISLGVGREYYRQFFEDGSSIMRCNSYPPCQEPELALGTGPHCDPTALTILLQDHVGGLQVFTEGKWQAVRPVRSALVINIGDTFMALSNGRYKSCLHRAVVNSERERLSLAFFVCPRGDRVVRPPRELLLLLEEEEEEEEEAVPRAFPDFTWTELLEFTQTHYRADTTTLQNFARRRFLASSP

SEQ ID NO: 652 - protein, 300 aa, Dinoroseobacter shibae
  misc_feature (1)..(300): Public GI ID no. 159043926
  misc_feature (1)..(300): Dinoroseobacter shibae DFL 12
  misc_feature (170)..(265): Pfam Name: 2OG-FeII_Oxy Pfam Description: 2OG-Fe(II) oxygenase superfamily
  misc_feature (1)..(300): Bit score of 114.9 for HMM based on sequences of Figure 1
  misc_feature (1)..(300): Functional Homolog Of SEQ ID NO. 471
MEVPVLDGAKLTRDPQGLAAELGAAARGPGFFLLTEHGIPEALITAVFAEGDRFFDLPSAEKARVAIDATNRGWAAEGTERLDPEGGAVDRKEAFNMGLDLAADDPRVLAGEPFRAANRWPKLPGFAPTLRRYFEAVQALGVQVMRLVARDLGLAPDHFDRDFDAPMATLRLLRYPAGDPAAGIGAGAHTDYGALTFLRTDGVPGLQLRVRGSDAWTDVPDVPGAYIVNIGDCLMRWSNDTYVSTPHRVLPPPRPRRSLAFFLDPNPDAVISALPGTGAPKYPETTGADYLRSRLEATYG

SEQ ID NO: 653 - protein, 324 aa, Burkholderia dolosa
  misc_feature (1)..(324): Public GI ID no. 254253748
  misc_feature (1)..(324): Burkholderia dolosa AUO158
  misc_feature (178)..(273): Pfam Name: 2OG-FeII_Oxy Pfam Description: 2OG-Fe(II) oxygenase superfamily
  misc_feature (1)..(324): Bit score of 94.6 for HMM based on sequences of Figure 1
  misc_feature (1)..(324): Functional Homolog Of SEQ ID NO. 471
MNVPIIDVSPLRSNEAAGWRHVMQQLLDAHTRVGFSILVNHGVGADIVDALFDASRSFHAWPLERKMAMRYRTTLRGYLPLNTSVLKASTLGAAKRPNHSDSFVVLGDLPESLLPDWKNSAMGGTQPWPEIAGFEHAARRYRRAMIELGDAILPCFAVMLGLPRDGLRDYFRVPNPILRLLHYPAVPHRGPDVFGSAPHTDYGCLTFVAQDDVGGLQVQSDRGEWFDVPVVKNSLVLNTGQVIARWSGGRIKPTPHRVLTPEAADRYSIAFFYDCGLETPLDLDAAPMSDSTSTYGRHLEAILRSNYAFVADEPARALPDAARC

SEQ ID NO: 654 - protein, 381 aa, Ipomoea nil
  misc_feature (1)..(381): Public GI ID no. 60498576
  misc_feature (220)..(319): Pfam Name: 2OG-FeII_Oxy Pfam Description: 2OG-Fe(II) oxygenase superfamily
  misc_feature (1)..(381): Bit score of 640.4 for HMM based on sequences of Figure 1
  misc_feature (1)..(381): Functional Homolog Of SEQ ID NO. 471
MAIECVTTTPTRSDDPKAAAVVFDSSVLRHETNIPTEFVWPEHEKPGSYAAPECPVPVIDLAAFRSGDPAAVAETLKLVNEACKKHGFFLVVNHGVDPDRISDAIRHMDRFFDLPLSSKEKALRKVGESCGYASSFTGRFSAKLPWKETLSFRYSAQKECSHIVEEYFQESLGQDFAHIGLVYQKYSNEMSKLALEIMEVLGMGLGVNRKHFSDFFQENDSVMRLNYCPPCQKPEITLGTGPHCDPTSLTILHQDNSVNGLQVCVDNEWRSVSPSPNAFVVNIGDTFMALSNGIYKSCLHRAVVNSTITRKSMAFFLCPHEDKVVTPPPELVDSTHPRLYPDFKWPTLLEFTQKHYRSDTDTLLSFSAWLQQNQTPHATHP

SEQ ID NO: 655 - protein, 389 aa, Arabidopsis lyrata
  misc_feature (1)..(389): Public GI ID no. 297852192
  misc_feature (1)..(389): Arabidopsis lyrata subsp. lyrata
  misc_feature (233)..(328): Pfam Name: 2OG-FeII_Oxy Pfam Description: 2OG-Fe(II) oxygenase superfamily
  misc_feature (1)..(389): Bit score of 424.6 for HMM based on sequences of Figure 1
  misc_feature (1)..(389): Functional Homolog Of SEQ ID NO. 471
MYIDKTVLNRTVTVCPYLNPFKLKGPNSREMNSSDVNFSLLQNQPNVPAEFFWPEKDVAPSEGDLDLPIIDLSGFLNGNEAETQLAAKAVREACMAHGTFLVVNHGFKSGLAEKALEISSLFFGLSKDEKLKAYRIPGNISGYTAGHSQRFSSNLPWNETLTLAFKKGPPHVVEEFLTSRLGNHRQEIGQVFQEFCDAMNGLIMDLMKLLGISMGLKDRTYYRRFFEDGSGIFRCNYYPPCKQPEKALGVGPHNDPTAITVLLQDDVVGLEVFAGDRWQTVRPRPGALVVNVGDTFMALSNGNYKSCYHRAVVNKEKVRRSLVFFSCPREDKTIVPPPELVEGKEASRQYPDFTWAQLQKFTQSGYRVDNTTLHNFSSWLVSNSDKKST

SEQ ID NO: 656 - protein, 410 aa, Vitis vinifera
  misc_feature (1)..(410): Public GI ID no. 302141747
  misc_feature (221)..(318): Pfam Name: 2OG-FeII_Oxy Pfam Description: 2OG-Fe(II) oxygenase superfamily
  misc_feature (1)..(410): Bit score of 441.7 for HMM based on sequences of Figure 1
  misc_feature (1)..(410): Functional Homolog Of SEQ ID NO. 471
MDLGASTLLCPPLELTDKKEHGVSPSDSSFFKKQPNIPMEFIWAKGEVGHAHEELREPVVDLEGFFSGDEVATQHAAMLVRSACLNHGFFQVINHRVDPHLITVAHDHMEAFFKLPWSKKLRAQRKPGSLWGYSGAHADRFSLKLPWKETLSFGFHENGSESVVEDFFKSTLGEEFEQTGLVYQKYCQAMKDLSLVLMELLAISLGVDRLHYRKFFEDGSSIMRCNYYPPCQEPGLAFGTGPHCDPTSLTILHQDQVGGLEVYVNNKWRTIRPRCDALVINLGDTFKALSNGRYKSCLHRAVVNRYKERRSLVFFVCPRENKVYYRADDATLQNFTKWLLSSNPPNHHYIVLDYLVNHDKFLSSRCSFSSIKNISVEWDMAGCNTWSSAIYTSSKMMDRSLSLSSEKDPD

SEQ ID NO: 657 - protein, 372 aa, Frankia alni
  misc_feature (1)..(372): Public GI ID no. 111224710
  misc_feature (1)..(372): Frankia alni ACN14a
  misc_feature (209)..(315): Pfam Name: 2OG-FeII_Oxy Pfam Description: 2OG-Fe(II) oxygenase superfamily
  misc_feature (1)..(372): Bit score of 87.4 for HMM based on sequences of Figure 1
  misc_feature (1)..(372): Functional Homolog Of SEQ ID NO. 471
MGEGIVPVVDISAWTGAWTGAWTGAGTDAGANAGDNGGADGGERAAERRAVARRLDEVCRTVGFAQIVGHGVPAGLIADTLAVTSEFFELPVEEKARLLPPGPEVNRGYAPFGSEALAYSLGAETALPDMFEAFNIGVDAWPAGDAYYEAEAHRMFAPNLWPARPERMRAVYVAYFDALARLAATLMSAFAQALDLPEDYFAGRTGRAPNVMRANRYLRQPGSPDAAPGQLRMGAHTDYGACTILLADDVPGLEILGPDGAWHGVRPEPGAFIVNIGDLLARWTNDRWRSTLHRVVPPPAAERGPALRRSIAFFHEGNHDAVVECLPTCVSADNPARYPAETVADHLMAKLLGPRTLTSSAATSTTTDRLST

SEQ ID NO: 658 - protein, 385 aa, Populus tremula
  misc_feature (1)..(385): Public GI ID no. 53139592
  misc_feature (230)..(328): Pfam Name: 2OG-FeII_Oxy Pfam Description: 2OG-Fe(II) oxygenase superfamily
  misc_feature (1)..(385): Bit score of 730.2 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAISTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMITPPHELVDTCNPRIYPDFTWPMLLEFTQKHYRADMKTLEVFTNWLHQRSLS

SEQ ID NO: 659 - protein, 337 aa, Pseudomonas syringae
  misc_feature (1)..(337): Public GI ID no. 320324375
  misc_feature (1)..(337): Pseudomonas syringae pv. glycinea str. race 4
  misc_feature (185)..(291): Pfam Name: 2OG-FeII_Oxy Pfam Description: 2OG-Fe(II) oxygenase superfamily
  misc_feature (1)..(337): Bit score of 122.3 for HMM based on sequences of Figure 1
  misc_feature (1)..(337): Functional Homolog Of SEQ ID NO. 471
MTLHYVPIINLAPYFSGEPDGKAAVAQAVNQACKDIGFLAITEHQIPKELIDKVSGLTRQFFDLPLAEKRKVDRPSPEMVRGYSAIAEESLSYSLEESAPGDLKESFSIGPSNVPNEDYYHNAESGSHFAPNVWPAEALLPGFKEAHQAYFEAMSELAQSLMRLFALALELDECFFDDRIDRHISMFRSLSYPDIKTEVEAGQLRASAHTDYGSLTIVRPDNALGGLQVRNQQGEWVDVPYVENGFVVNIGDLMMQWTNDQWISTLHRVVNPPISSEQDNRRQSLVFFHQPNYDTLIECLPGCLPPGTTPRHAPVTSGDHLLAKFVKQTTFGGSKVA

SEQ ID NO: 660 - protein, 372 aa, Sesbania rostrata
  misc_feature (1)..(372): Public GI ID no. 68509984
  misc_feature (216)..(313): Pfam Name: 2OG-FeII_Oxy Pfam Description: 2OG-Fe(II) oxygenase superfamily
  misc_feature (1)..(372): Bit score of 508.0 for HMM based on sequences of Figure 1
  misc_feature (1)..(372): Functional Homolog Of SEQ ID NO. 471
MDSGLCLVSGLNHKDVQTRFFGPSWLQMQSHVPMNFIWPKECLVNAHEELQAPLVDLDGFLRGDEEATHRAAELISKACLTHGFFQVINHGVDQRLIGEAYNQMDGFFKLPIDRKLSVRKIPGSMWGYSGAHADRFSSKLPWKETLSFPFHDNNSEPVVTNYFNSTLGKTFEQTGVTFQKYCEAMKGLGMKLMELLAISLDVDRFHYKDLFEDGCSIMRCNYYPSCQQPSLALGTGPHCDPTTLTILHQDQVGGLDVFADKKWQTVRPLPHALVVNIGDTFTALSNGRYKSCLHRAVVNQYKERRSLAFFVCPKEDKVVRPPEDIVRRDGTKQYPDFTWSKLLEFTQKYYRADEDTLQNFTKWLLSSKPQTL

SEQ ID NO: 661 - protein, 334 aa, Mycosphaerella graminicola
  misc_feature (1)..(334): Public GI ID no. 339470611
  misc_feature (1)..(334): Mycosphaerella graminicola IPO323
  misc_feature (184)..(282): Pfam Name: 2OG-FeII_Oxy Pfam Description: 2OG-Fe(II) oxygenase superfamily
  misc_feature (1)..(334): Bit score of 71.7 for HMM based on sequences of Figure 1
  misc_feature (1)..(334): Functional Homolog Of SEQ ID NO. 471
MTIPLKEVSIAPLPTIDYDLLLARDRFEIARLVDICRTHGFFYLKFAGSQAERLLSNSDDVVDLMRDYFQQPLETKLKDVRGTVTHGHLCYDHSYCPTGRYTGAKRGERDCYETLKISEAEMDARAPQLPNVVHQHTELFSDFISGSHAALITVLKCLSIGMNLDETERFENKHRPNEPACTTMVLFRYPRQVVDGEGIGHNVHTDIGSLTLLYCQDWGLQLLSPENNEWGFVEPRPGHTIINVGDSLRFLSNNQLRSCVHRVIPLTERQETDRYSIAYFLRAEDQSVFVDSKKRELSARSWHDEKYEVFRQPHEVQEIDMVLTGGMEKQGRLC

SEQ ID NO: 662 - DNA, 1371 bp, Populus trichocarpa
  misc_feature (1)..(1371): Ceres Annot ID no. 1468944
  misc_feature (1)..(1371): Encodes the peptide sequence at SEQ ID NO. 663
atggcaatagattgcatcaaaaccatgccttcaaaaaccacccatcatcaccatccaaaagatcaagatcaatgcaaagatgataacaagtctttagtgtttgatgcacaagttcttagataccaatcaagcatacctcaacagttcatttggcctgaccatgaaaagcctagtgctaatgcacctaaactccaagttccacttatagacttgggtgatttcctctctggtaaccctgatgctgcaatggaagcttcaagacttgttggtgaagcatgtcaaaaacatggtttctttcttgttgttaatcatggagttgataagacactcattgctcatgctcttaattacatggacaacttctttgaattgcctctttctgagaaacaaaaggctcaaagaaaaattggcgagtcttgtggatatgctagtagctttactggcaggttttcctccaaacttccatggaaagaaacactttcttttagctatacagctgagaagaattcatcaaaacatattgagcaatattttcatgacagaatgggggaagacttcgccaaattcggaagggtgtaccaggattactgcgaggccatgagcactttgtcactagggatcatggagctattaggaatgagccttggtgtgagcagagcacatttcagagaatatttcgaagagaatgattcaataatgaggcttaactactaccctccatgccaaaagcctgaacttactttaggaactggtcctcattgtgatccaacttctttaaccatccttcatcaagaccaagtgggtggtcttcaagtgtatgtagacaacgaatggtgttcgattagccccaatttcgacgcttttgtcgttaacattggcgacaccttcatggctctatcaaatggtagatacaagagttgtttgcaccgagcggtggtgaacagccaaacgccaagaaaatctcttgctttcttcttgtgtccaaggaatgacaagaaggtaactccaccaaaggaattagtggacacatgcaatccaagaatatatccagatttcacatggcctatgttgcttgaattcacacaaaagcattacagagctgacatgaagacacttgagatgttcacaaattggcttcaacaaagaaatacctggtggcatgctataggcctctttatcaaggacaaaaaaaggaaagtgatactgatggggaggggaggggagtggaaagggaaagaaatgaagcttgaaagagatggggattttgatgagatttggaggggaacaacactacatgaagagaggaaaaaaaaattgagactctctcaaaggacaactttcctttatgcccataggtctggtaattactag

SEQ ID NO: 663 - protein, 448 aa, Populus trichocarpa
  misc_feature (1)..(448): Ceres Annot ID no. 1468944
  misc_feature (222)..(320): Pfam Name: 2OG-FeII_Oxy Pfam Description: 2OG-Fe(II) oxygenase superfamily
  misc_feature (1)..(448): Bit score of 719.1 for HMM based on sequences of Figure 1
  misc_feature (1)..(448): Functional Homolog Of SEQ ID NO. 471
MPSKTTHHHHPKDQDQCKDDNKSLVFDAQVLRYQSSIPQQFIWPDHEKPSANAPKLQVPLIDLGDFLSGNPDAAMEASRLVGEACQKHGFFLVVNHGVDKTLIAHALNYMDNFFELPLSEKQKAQRKIGESCGYASSFTGRFSSKLPWKETLSFSYTAEKNSSKHIEQYFHDRMGEDFAKFGRVYQDYCEAMSTLSLGIMELLGMSLGVSRAHFREYFEENDSIMRLNYYPPCQKPELTLGTGPHCDPTSLTILHQDQVGGLQVYVDNEWCSISPNFDAFVVNIGDTFMALSNGRYKSCLHRAVVNSQTPRKSLAFFLCPRNDKKVTPPKELVDTCNPRIYPDFTWPMLLEFTQKHYRADMKTLEMFTNWLQQRNTWWHAIGLFIKDKKRKVILMGRGGEWKGKEMKLERDGDFDEIWRGTTLHEERKKKLRLSQRTTFLYAHRSGNY

SEQ ID NO: 664 - protein, 337 aa, Pseudomonas syringae
  misc_feature (1)..(337): Public GI ID no. 330890071
  misc_feature (1)..(337): Pseudomonas syringae pv. mori str. 301020
  misc_feature (185)..(291): Pfam Name: 2OG-FeII_Oxy Pfam Description: 2OG-Fe(II) oxygenase superfamily
  misc_feature (1)..(337): Bit score of 125.2 for HMM based on sequences of Figure 1
  misc_feature (1)..(337): Functional Homolog Of SEQ ID NO. 471
MTLHYVPIINLAPYFSGEPDGKAAVAQAVNQACKDIGFLVITEHQIPKELIDKVSGLTRQFFDLPLAEKRKVDRPSPEMVRGYSAIAEESLSYSLEESAPGDLKESFSIGPSNVPNEDYYHNAEAGSHFAPNVWPDEALLPGFKEAYQAYFEAMTELAQSLMRLFALALELDECFFDDRIDRHISMFRSLSYPDIKTEVEAGQLRASAHTDYGSLTIVRPDNALGGLQVRNQQGEWVDVPYVENGFVVNIGDLMMQWTNDQWISTLHRVVNPPISSEQDNRRQSLVFFHQPNYDTLIECLPGCLPPGTTPRHAPVTSGDHLLAKFVKQTTFGGSKVA

SEQ ID NO: 665 - protein, 378 aa, Vitis vinifera
  misc_feature (1)..(378): Public GI ID no. 225459697
  misc_feature (221)..(318): Pfam Name: 2OG-FeII_Oxy Pfam Description: 2OG-Fe(II) oxygenase superfamily
  misc_feature (1)..(378): Bit score of 520.8 for HMM based on sequences of Figure 1
  misc_feature (1)..(378): Functional Homolog Of SEQ ID NO. 471
MDLGASTLLCPPLELTDKKEHGVSPSDSSFFKKQPNIPMEFIWAKGEVGHAHEELREPVVDLEGFFSGDEVATQHAAMLVRSACLNHGFFQVINHRVDPHLITVAHDHMEAFFKLPWSKKLRAQRKPGSLWGYSGAHADRFSLKLPWKETLSFGFHENGSESVVEDFFKSTLGEEFEQTGLVYQKYCQAMKDLSLVLMELLAISLGVDRLHYRKFFEDGSSIMRCNYYPPCQEPGLAFGTGPHCDPTSLTILHQDQVGGLEVYVNNKWRTIRPRCDALVINLGDTFKALSNGRYKSCLHRAVVNRYKERRSLVFFVCPRENKVVTPPQDLVCREGTRKYPDFKWSDLLEFTQKYYRADDATLQNFTKWLLSSNPPNHH

SEQ ID NO: 666 - protein, 334 aa, Variovorax paradoxus
  misc_feature (1)..(334): Public GI ID no. 239817805
  misc_feature (1)..(334): Variovorax paradoxus S110
  misc_feature (183)..(287): Pfam Name: 2OG-FeII_Oxy Pfam Description: 2OG-Fe(II) oxygenase superfamily
  misc_feature (1)..(334): Bit score of 133.5 for HMM based on sequences of Figure 1
  misc_feature (1)..(334): Functional Homolog Of SEQ ID NO. 471
MTTLLSVPIIDLAPYFAGTAEGKAQVAAKVDEACRSIGFLVITNHGIPAELIARVSQLSRRFFDMPLAEKRKVDRPREDAVRGYSAVGEEGLSYSLEEAAPGDLKESFSIGPSNVPDDDYHRGPAAGPHFEPNSWPPIDGFREAYESYFEAMSDLSRSLMRIFALGLALPEPFFDDKIDRHISMFRVLSYPPQREAPLPGQLRAGAHSDYGSLTIVLPDDKGLQVFNKAGQWVDVPQVEGGLVVNIADLMMQWTNDQWVSTLHRVVNPPFEMASTNRRQSLVFFHQPNYDAMVECLPSCLAPGEQPKYAPISSGDHLTSKFVKQTTFGGTKVTV

SEQ ID NO: 667 - protein, 377 aa, Physcomitrella patens
  misc_feature (1)..(377): Public GI ID no. 195976667
  misc_feature (1)..(377): Physcomitrella patens subsp. patens
  misc_feature (217)..(312): Pfam Name: 2OG-FeII_Oxy Pfam Description: 2OG-Fe(II) oxygenase superfamily
  misc_feature (1)..(377): Bit score of 253.9 for HMM based on sequences of Figure 1
  misc_feature (1)..(377): Functional Homolog Of SEQ ID NO. 471
MAVSMSDANTSMHAGLVSPLPQNSTQLPQEFVEADQKHLSNAELESIEDPELDFPVLDLSLLSGDKKHHDEVITAAAEACQNWGFFQIQNHGIDQRLIEKCKEEALRMFQLPLEAKKRCDRPPGTSFGYGSNTWVNQKVQHWAESFHLQLKPMSNVPAMASKLFPDQTSSQQFSSVVEEYMETVQNLAIQVVEILTEGLGLPPAYFSQHLQRERMVSMRLNFYPPCPEPSKAIGLRAHTDPHLITILHQDTVRGLQVQVAEKWVTVKPRPDCFVVNIGDIFQILSNTRYKSGLHRAVVNGQFQRLSMACFLNLPLDCVVAAPPELITTDCPQKYRPFLWLEYLKHAYLYHPITGNDRHEKFFLKPSGDIPVAASSVH

SEQ ID NO: 668 - protein, 376 aa, Nerium oleander
  misc_feature (1)..(376): Public GI ID no. 51011360
  misc_feature (223)..(320): Pfam Name: 2OG-FeII_Oxy Pfam Description: 2OG-Fe(II) oxygenase superfamily
  misc_feature (1)..(376): Bit score of 713.2 for HMM based on sequences of Figure 1
  misc_feature (1)..(376): Functional Homolog Of SEQ ID NO. 471
MAIDCMFKSKSTVPEMCKDEKKPLVFDASLLQHQTHIPTEFIWPEHEKPCPNPREHPVPLIDLGGFLSGNPVAAMEASRLVGEACQEHGFFLVVNHGVDADLIADAHRYMDYFFELPLCDKQRAQRKLGEHCGYASSFTGKISTKLPWKETLSFRFSAEKRSSHMVEEYFEKTLGDEFAHLGNVYQEYCNAMSTLSLGIMELLGMSLGISRESFKDFFQDNESIMRLNYYPPCQKPELTLGTGPHCDPTSLTILHQDTVGGLQVFVDGEWRSISPNVSAFVVNIGDTFVALSNGRYKSCLHRAVVNNKTPRKSLAFFLCPKEDKVVSPPSELVDSNNPRIYPDFTWAKLLEFTQKHYRADMNTLQIFSNWLQQKNS

SEQ ID NO: 669 - protein, 387 aa, Ricinus communis
  misc_feature (1)..(387): Public GI ID no. 255572455
  misc_feature (231)..(328): Pfam Name: 2OG-FeII_Oxy Pfam Description: 2OG-Fe(II) oxygenase superfamily
  misc_feature (1)..(387): Bit score of 522.5 for HMM based on sequences of Figure 1
  misc_feature (1)..(387): Functional Homolog Of SEQ ID NO. 471
MSLLNLMKTTTSTLLLCPPMDTKDHKSATTGVNFLFDSSFLQKQPKLPTEFIWPNGDLVSNQDELKEPLIDLDGILKGDEVETAHAAELVRAACLNHGFFQVTNHGVDASLIRAAHEEVDTIFKLPLDKKLSVRRMPGSVYGYSGAHADRYSFKLPWKETFTFGYSRSDSEPIVVDYFKHVLGEDYERTGGIYQKFCEEMKKLSFVIFELLAISLGVDRFHYRKYFEDGSSIMRCNYYPACNNSSLTLGTGPHCDPTSLTILHQDEVGGLEVFANSKWQAIRPRPDAFVINIGDTFTALSNGRYKSCLHRAVLNRERERRSLVFFVCPKEDKVVRPPQDLVCREGPRKYPDFTWSDLLEFTQKHYRADAATLQSFIQWLLSSKPSNF

SEQ ID NO: 670 - protein, 392 aa, Dianthus caryophyllus
  misc_feature (1)..(392): Public GI ID no. 189409355
  misc_feature (234)..(331): Pfam Name: 2OG-FeII_Oxy Pfam Description: 2OG-Fe(II) oxygenase superfamily
  misc_feature (1)..(392): Bit score of 663.8 for HMM based on sequences of Figure 1
  misc_feature (1)..(392): Functional Homolog Of SEQ ID NO. 471
MAIDCMRSISSITPKPHQMGTINDQNNNNKPFVFDASFLNHQSNIPDQFIWPDGDKPSNNIYLEDLPVPMLDLQGFLTGNPEAVMEASRVVGEACVKHGFFLVVNHGVSNELVRNAHKMMDEFFEEPLAQKQKAQRKLGEHCGYASSFTGRFSSNLPWKETLSFQFSSEESCSSKIVQDYFTNTLGHNFDHLGTVYQDYCEAMSQLSLGIMELLGLSLGVGRRYFKEFFQGHESVMRLNYYPPCQRPDLTLGTGPHCDPTSLTILHQDQVGGLQVFVDDKWRPISPNFNAFVVNIGDTFTALSNGRYKSCLHRAVTNIEKPRKSLAFFLCPSKDRLVKPPQALVNDENDRVYPDFTWPMLLEFTQKHYRADMNTLNAFSKWVQLHRRDDQEK

SEQ ID NO: 671 - protein, 349 aa, Selaginella moellendorffii
  misc_feature (1)..(349): Public GI ID no. 302800904
  misc_feature (187)..(284): Pfam Name: 2OG-FeII_Oxy Pfam Description: 2OG-Fe(II) oxygenase superfamily
  misc_feature (1)..(349): Bit score of 329.7 for HMM based on sequences of Figure 1
  misc_feature (1)..(349): Functional Homolog Of SEQ ID NO. 471
MNTSCELESYVWPRGDCSLPEHGKFASQQDVPTIDLAGGSKAKVDEIGRACRQSGFFQVVNHGVDHELVNQVHASARQFFEFPSDTKLRAARSAGNSFGFAGKFAGRFKSKCPWKETFSLQYTPNSNIKDYMIKVYTAEQHEQHARYETYCKAMEKLGRELIELIAQSLELAPDALNSYFDDGFSIFRMNMYPPSEHFPRLLGTGPHTDPCALTILHQDEVGGLQVYNRDETWVTVEPRADAFVISIGDTFQQALCNHRYKSAKHRAVIHATRARHSLVFFINPGLDTVIRPIPELVVKSKVDEEQDRERPCVEFNWGQLLEFTQKHYRTDVHTLDAFESYLRKTSQAA

SEQ ID NO: 672 - protein, 376 aa, Physcomitrella patens
  misc_feature (1)..(376): Public GI ID no. 168012845
  misc_feature (1)..(376): Physcomitrella patens subsp. patens
  misc_feature (227)..(324): Pfam Name: 2OG-FeII_Oxy Pfam Description: 2OG-Fe(II) oxygenase superfamily
  misc_feature (1)..(376): Bit score of 258.3 for HMM based on sequences of Figure 1
  misc_feature (1)..(376): Functional Homolog Of SEQ ID NO. 471
MASNQPPNPFSLIRAASITPAAQSSLQSLLSQGSQDLADFVWPEDERPTIPHNDYRRDRELPVIDLSGLQDGSDETKMKLAKRIAAAGSEWGFFHLINHGIPVADLDEVQLQTRRFFELPMEHKQRAMSLETANANNVYGYGLNTTGYKYAGRPWIERFQCSWSPKSNLREQAQRLLDGQAFHDFQAAVESFCSGAEKLAKLTLELCALGLGLAPDTFSQHMNPSQSIARLNYYPACPTPDLTLGLGAHTDPYTLTFLHQCQVGGLQVCKDGKWITVKPRRGAYVVNVGDNLQAWTNGRFKSVEHRAVLNDKVSRLSLVFFYAPPLDTVISAPQELIQADGKRRYKSFTWGEYLDYLKRQNFEKGKNERWVEGFAL

SEQ ID NO: 673 - protein, 345 aa, Glycine max
  misc_feature (1)..(345): Public GI ID no. 217037949
  misc_feature (228)..(291): Pfam Name: 2OG-FeII_Oxy Pfam Description: 2OG-Fe(II) oxygenase superfamily
  misc_feature (1)..(345): Bit score of 519.1 for HMM based on sequences of Figure 1
  misc_feature (1)..(345): Functional Homolog Of SEQ ID NO. 471
MAIECITNIQSMSQPQKHHQEHKEDEAPLVFDASLLRHQLNLPKQFIWPDEEKPCMNVPELGVPLIDLGGFLSGDPVATMEAARIVGEACQKHGFFLVVNHGIDANLISNAHSYMDDFFEVPLSQKQRAQRKTGEHCGYASSFTGRFSSKLPWKETLSFQYSAEENSSTIVKDYLCNTLEKEFEQFGRVYQDYCDAMSNLSLGIMELLGMSLGVGKACFREFFEENNSIMRLNYYPPCQKPDLTLGTGPHCDPTSLTILHQDQVGGLQVFVDNEWHSISPNFNAFVVNIGDKVVSPPSELVDDLTPRIYPDFTWPMLLEFTQKHYRADMKTLEAFTNWLLQRKMS

SEQ ID NO: 674 - protein, 350 aa, Frankia
  misc_feature (1)..(350): Public GI ID no. 312195518
  misc_feature (1)..(350): Frankia sp. EuI1c
  misc_feature (187)..(291): Pfam Name: 2OG-FeII_Oxy Pfam Description: 2OG-Fe(II) oxygenase superfamily
  misc_feature (1)..(350): Bit score of 94.2 for HMM based on sequences of Figure 1
  misc_feature (1)..(350): Functional Homolog Of SEQ ID NO. 471
MGSARTSHGTLDVPVIDLSGYRRGEPAAARALAAAVDDAARTVGFMQVVGHGIPAGTEAGLTAALDTFFALPMATKLASRPASTAVNRGYSPPRSERLSHSLGVYSPADLFEAFNVGIEAGEYPGLGLPASYYADNIWPAGAAGFRAGVERWFAAARQLAETLTGVFALALGLPAGYFDAFQSHSLDVLRMNNYLVPGDVTLEEGQVGMGAHTDYGIVTILWADPVPGLQILDRAGRWHDVLPAPGALLVNLGDLLARWTNDRWVSTMHRVVPPRDAGGRLVRRRSAAYFHDGDVDAVIACLPGCATPDNPARYEPVTVADHLTAKLTGSRGLVLNAAATHEAARLRPTD

SEQ ID NO: 675 - protein, 378 aa, Solanum lycopersicum
  misc_feature (1)..(378): Public GI ID no. 4321496
  misc_feature (219)..(317): Pfam Name: 2OG-FeII_Oxy Pfam Description: 2OG-Fe(II) oxygenase superfamily
  misc_feature (1)..(378): Bit score of 734.1 for HMM based on sequences of Figure 1
  misc_feature (1)..(378): Functional Homolog Of SEQ ID NO. 471
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 676 - protein, 379 aa, Citrullus lanatus
  misc_feature (1)..(379): Public GI ID no. 5359492
  misc_feature (1)..(379): Citrullus lanatus subsp. vulgaris
  misc_feature (216)..(314): Pfam Name: 2OG-FeII_Oxy Pfam Description: 2OG-Fe(II) oxygenase superfamily
  misc_feature (1)..(379): Bit score of 542.4 for HMM based on sequences of Figure 1
  misc_feature (1)..(379): Functional Homolog Of SEQ ID NO. 471
MAMKCMMSTGESKEMKSKLHRVEFGCSEESMVPENFVWPDEFKAKDGAPELHVPHIDLHKFLNGNESDIEEATRLVDEACRKHGFFVLVNHGVDMELIKGVHECMDEFFTLPFDVKQKSQRKFGENYGYANSFIGRFSNNLPWKETLSLPYVANHNSTSVQDFVSKCVGPELSHQGKVYQECGKALSDLSLKIVELLGLSLGVPKEKFKKFYEDNDSIIRLNYYPPCEKPELTLGTGPHCDPTSITILHQDHVSGLQVYVDDEWHSIPPTKDSFVINIGDTFMALTNGVYKSCFHRAVVNCKEVRKSMAFFLCPAADKVVRAPDEVVEKNPPRKFPDYTWPMLLELTQKFYRADSNTFQAFIPWLEKQKSANTIAPPAL

SEQ ID NO: 677 - protein, 385 aa, Populus tremula
  misc_feature (1)..(385): Public GI ID no. 53139608
  misc_feature (230)..(328): Pfam Name: 2OG-FeII_Oxy Pfam Description: 2OG-Fe(II) oxygenase superfamily
  misc_feature (1)..(385): Bit score of 728.7 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVSTNWLHQRSLS

SEQ ID NO: 678 - protein, 354 aa, Grosmannia clavigera
  misc_feature (1)..(354): Public GI ID no. 320588046
  misc_feature (1)..(354): Grosmannia clavigera kw1407
  misc_feature (214)..(309): Pfam Name: 2OG-FeII_Oxy Pfam Description: 2OG-Fe(II) oxygenase superfamily
  misc_feature (1)..(354): Bit score of 130.4 for HMM based on sequences of Figure 1
  misc_feature (1)..(354): Functional Homolog Of SEQ ID NO. 471
MTTHIRLSSGDGPVYRTVLQTPLRDATAAEIPVIDIAGIFSSSAAERAAVATQIHAAATGTGFFYMRGHGIAAAVTEAARTACLDFFRQPLATKQLADATKSRFFNGYKSPQTQRINAAESVDVRETFSWVYDPAYDPAVQTTETSIPPAIAVWLRGEAFPWLATANLPHFRTAIVAYWQACLGLARALLHSFALSLGLPETALDARFSHPDAALALNYYPPIAATTPDVSIGSHTDFQLFTILWQDDCGGLQVLSRSGQWLTAPPLADTLVVNIGDFFQRITNDRYVSTVHRAQNHSGRERVSMPFFFGFNRNEVCGVLDTCVGPGETKKYPDIRCADWVDRRVRAMHMGSST

SEQ ID NO: 679 - protein, 385 aa, Populus tremula
  misc_feature (1)..(385): Public GI ID no. 53139640
  misc_feature (230)..(328): Pfam Name: 2OG-FeII_Oxy Pfam Description: 2OG-Fe(II) oxygenase superfamily
  misc_feature (1)..(385): Bit score of 730.5 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNEDDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 680 - protein, 392 aa, Pyrus communis
  misc_feature (1)..(392): Public GI ID no. 333440997
  misc_feature (235)..(333): Pfam Name: 2OG-FeII_Oxy Pfam Description: 2OG-Fe(II) oxygenase superfamily
  misc_feature (1)..(392): Bit score of 702.5 for HMM based on sequences of Figure 1
  misc_feature (1)..(392): Functional Homolog Of SEQ ID NO. 471
MAVECMIKPSSMQTMAQPPSPQTQKTQQHKEDDQKPLVFDASVLRYQTEIPSQFIWPDDEKPCKNTPELRVPLIDLGGFLSGDKEAAAKASQLVGEACQKHGFFLIVNHGVNDKLIADAHRCMDDFFGMPLSEKQRAQRKAGESCGYASSFTGRFSSKLPWKETLSFSYSAKKGSTNIIQDYFCNKMGEEFKEFGRVYQDYSEAMSTLSIGIMELLGLSLGVDRAYFKEFFDDNDSIMRLNYYPPCQKPEQTLGTGPHCDPTSLTILHQDQVGGLEVFVDDQWHSISPNLNAFVVNIGDTFMALSNGNYKSGLHRAVVNSETPRKSLAFFLCPRDDKVVKPPSGLVDTLSPRKYPDFTWSMLLEFIMKHYRADVKTLQAFSNWVQQKTNQKL

SEQ ID NO: 681 - protein, 335 aa, Albugo laibachii
  misc_feature (1)..(335): Public GI ID no. 325189696
  misc_feature (1)..(335): Albugo laibachii Nc14
  misc_feature (186)..(287): Pfam Name: 2OG-FeII_Oxy Pfam Description: 2OG-Fe(II) oxygenase superfamily
  misc_feature (1)..(335): Bit score of 84.8 for HMM based on sequences of Figure 1
  misc_feature (1)..(335): Functional Homolog Of SEQ ID NO. 471
MPSHETQVIDLDQLISCDQKLDGDALLDVAIAVNDAFSNCGFLVVINHGVSQEKGTNLHENAMRFFLETSNAEKTKCAFRSPIPRGYSGVSKENFAILAGASRPNDLVEKYRMGPITTDSMSDSKEYQLMYYPNKWPDNDTFELQSSMEAYYAEMERLPHLLLRIFEVALKVPEGFFLQHMQNHTSILSVNHYPPIKKQIQKGQLRLAEHTDVDLFTILRPDYDDRYGCLQVRHPHDWQSVPIIPGSLVVNLGDCFSYWTNNHWKSTKHRVVIPQESEGQILSRLAMGFFVGLCYDAAITRMPFIPIEAWRHKDTTYVDWRKDRIKQAMYNLQIQ

SEQ ID NO: 682 - protein, 372 aa, Solanum lycopersicum
  misc_feature (1)..(372): Public GI ID no. 4321494
  misc_feature (217)..(314): Pfam Name: 2OG-FeII_Oxy Pfam Description: 2OG-Fe(II) oxygenase superfamily
  misc_feature (1)..(372): Bit score of 678.2 for HMM based on sequences of Figure 1
  misc_feature (1)..(372): Functional Homolog Of SEQ ID NO. 471
MAIDCMVMPMIQDEKKSLIFDSSVLKNESNIPRQFIWPDHEKPSGFVGELDVPLIDLGAFLSGDPIAAKRESSLVDEACKKHGFFLVANHGVDTNLISLAHRYMDMFFELPLSDKQKIQRKRGDHCGYASSFTERFSSKLPWKETLSFPYSTLQGSSHMLDQYFLKTMGEDFSHIGKFYQEYCNAMSTLSSGIMELLGESLGVSKNHFKQFFEENESIMRLNYYPTCLKPDLALGTGPHCDPTSLTILHQDNVSGLQVFMDNQWRSISPNNSAFVVNIGDTFMALSNGRYKSCLHRAVVNNKTPRKSLAFFLCPKKDKVVRPPAELVDSNNPRIYPDFTWPTLFEFTQKHYRADTNTLRFFSTWLQQKTTEI

SEQ ID NO: 683 - protein, 385 aa, Populus tremula
  misc_feature (1)..(385): Public GI ID no. 53139588
  misc_feature (230)..(328): Pfam Name: 2OG-FeII_Oxy Pfam Description: 2OG-Fe(II) oxygenase superfamily
  misc_feature (1)..(385): Bit score of 733.2 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 684 - protein, 321 aa, Albugo laibachii
  misc_feature (1)..(321): Public GI ID no. 325184325
  misc_feature (1)..(321): Albugo laibachii Nc14
  misc_feature (171)..(271): Pfam Name: 2OG-FeII_Oxy Pfam Description: 2OG-Fe(II) oxygenase superfamily
  misc_feature (1)..(321): Bit score of 136.2 for HMM based on sequences of Figure 1
  misc_feature (1)..(321): Functional Homolog Of SEQ ID NO. 471
MQCKDDQSIRENIASLDETVRIIANAAEECGFFYIENHGVAVELLQAFKDTMKEFFDLPKDVKNGIRRKENNPTGYFDAEITRNVIDWKEMFDYAQFLESQPSKSEHSNQWPAEEVLPNFRKRVIQTNLIMENIARRICMMLAVGLGQPLNFFDKFFGVQDPIDFCSGNSSTLRLNYYPVSSRENTTLGVHPHTDLGAVTILLQDDSISALQVYHPKTSSWLPVPPISNTFIVNLGDMMQVWSNDKYRAPVHRVLSAENSDRYSAPYFYHPFMHSTIEPITKNGEKPHYRPISWLDFLMERVKGNYADIGEEVQINRYRII

SEQ ID NO: 685 - protein, 346 aa, Ricinus communis
  misc_feature (1)..(346): Public GI ID no. 255556241
  misc_feature (194)..(291): Pfam Name: 2OG-FeII_Oxy Pfam Description: 2OG-Fe(II) oxygenase superfamily
  misc_feature (1)..(346): Bit score of 210.3 for HMM based on sequences of Figure 1
  misc_feature (1)..(346): Functional Homolog Of SEQ ID NO. 471
MGEIDPSFFQDLEQRPKFRPTQLEEIPVIDLSVSSSNGIQEVISKIGEACKKYGFFQVINHGVPVELRQETEKVAKEFFDQSLEEKGKVQRNEVDPMGYHDSEHTKNIRDWKEVFDYLVLDPTLVPASDDPHDNELRTLTNQWPQYPSQFRGLCQEYAKQVEKLAFKLLELICLSLGLPADRLNGYFKDQISFARLNHYPPCPAPHLALGVGRHKDGGALTVLAQDDVGGLEIALRSDGEWVPVKPIPNAFIFNIGNCMQVWTNDLYWSAEHRVVVNSQKERFSMPFFFFPSHYVQIKPLDELLNQQNPPKYEEFNWGKFFASRNRSDYKKQEKENIQIDHFKASE

SEQ ID NO: 686 - protein, 397 aa, Selaginella moellendorffii
  misc_feature (1)..(397): Public GI ID no. 302790077
  misc_feature (249)..(346): Pfam Name: 2OG-FeII_Oxy Pfam Description: 2OG-Fe(II) oxygenase superfamily
  misc_feature (1)..(397): Bit score of 263.3 for HMM based on sequences of Figure 1
  misc_feature (1)..(397): Functional Homolog Of SEQ ID NO. 471
MAVQSRPAGFPSFASSPRRDRHTKERIPRSLLQLQSSTATTSESAAALERQNICKLSALLKDTNLLPERYVIPESHRARLSHDAFLPEVELPMIDFETLKSGAGTESLAREVGNACRDWGFFQIVNHGVPDDLIQEMLLHADQFFHLPYEQKEKAAIFPRPLGYNGRYKDLSSSAPWVEAMAMQQTPYSTVDETVDRVWPGEGNPRLRRALRRYHAEMEKLGQSVVQLIALSLGLERRTFSRHFEESSSTFRWNHYPPCPLPSKALGLLAHSDPSAITILHQDSVGGLQIRKDGRWIAVKPRPDTFVINLGDVFQAWTNGRYKSVEHRAVVNQKQGRLSMVFFYGPQEDYVITPPDELIDEDHPLRYRPFTWGDYSAARLSIPAHGKRHLDVFAGAL

SEQ ID NO: 687 - DNA, 1641 bp, Populus trichocarpa
  misc_feature (1)..(1641): Ceres Annot ID no. 1444168
  misc_feature (1)..(1641): Encodes the peptide sequence at SEQ ID NO. 688
atggtaatgcctcctactcttcctcctcctcgacagccattagtatttgatgcttcaattcttcaacaccaagccaatataccctctcagttcatttggcctgaccacgaaaaaccatgccttgaatccccaaaacttgcaatcccccctattgattttggaagcttcctcactggagatcctttggcagtctcaaaagctactcagctagtaaatgaggcatgcaagaagcatggattctttctagttgttaaccatggagttgattcaaagcttatagctaaagctcatgagtatatgaacatgttttttggcatacaactctcagagaagcaaagagctcaaagaaagataggagagcaatatgggtatgctagtagcttcactggaagattctcctccaaacttccatggaaagaaacactttctttccgatattgtgctgacaatcagtcttctgacatcgtccaagaatacttcttgaatgtaatgggagaaaatttcaaacaattcgggaaggtttaccaagaatattgtgaagccatgaacactctttctcttggaattatggagctattaggagtaagtctaggagttggaagagaatattttagagatttcttcgaaggaaacgattcgataatgagactgaattactaccctccttgccaaaagccggatttaactcttggcactgggcctcattgtgatcccacatccttaacaatcctccatcaagatcatgtcggtggccttcaagtgttcgtcgatgaaaaatggcactccgtcagtcctgatccggaagctttcgtcgtcaacatcggtgacacattcacggctctatcaaatggcattttcaagagttgcttgcatagagcggtggtaaataatgtaacagtaaggaaatcccttgctttctttctctgtccaaaactggataaggtggtgaagccaccaaataccttgatcgactctaagaatccgagggccgaggaaagtgagattataggagtggacaatgctaggtgcagtgaaggagggacttggttcttcatgatattgaagagattttcaacattgattatcacgattgaattcaaaatgggatatgtcaaggcccttaccgtcaccaacatgcaaataatcattaccaagatagagtgcagaatcggtcaaagttgcaagatcaggtatgacgtgttgttttgcgccggtgtcgggaaaccaagtcgcaacagaagcatttccaacagcaaggtgagcagaggattgctgggtactactgcgaaactggggacaatagggagttgtgtgaccgaaactggagcacaattgacagcggacatgctgctgtccagaccactgcccagccctgagttgcgcctggagccctctccttctgctgcaagtatagaggaggaggatcgcaacgccttgcgtaaaagtaaagagagaagccaaggagatggagatgtgagcttttgttcggctagagaagagacagatgcaagaggcaaagtggatgaaagggaaaggaagaagagaaaagttgttagagaaggagatgcaggaggtagagtggatgaaagggaaaggaagaagagaaaaattgtctttggcggctttgtgttaagttattag

SEQ ID NO: 688 - protein, 544 aa, Populus trichocarpa
  misc_feature (1)..(544): Ceres Annot ID no. 1444168
  misc_feature (210)..(308): Pfam Name: 2OG-FeII_Oxy Pfam Description: 2OG-Fe(II) oxygenase superfamily
  misc_feature (1)..(544): Bit score of 607.1 for HMM based on sequences of Figure 1
  misc_feature (1)..(544): Functional Homolog Of SEQ ID NO. 471
MPPTLPPPRQPLVFDASILQHQANIPSQFIWPDHEKPCLESPKLAIPPIDFGSFLTGDPLAVSKATQLVNEACKKHGFFLVVNHGVDSKLIAKAHEYMNMFFGIQLSEKQRAQRKIGEQYGYASSFTGRFSSKLPWKETLSFRYCADNQSSDIVQEYFLNVMGENFKQFGKVYQEYCEAMNTLSLGIMELLGVSLGVGREYFRDFFEGNDSIMRLNYYPPCQKPDLTLGTGPHCDPTSLTILHQDHVGGLQVFVDEKWHSVSPDPEAFVVNIGDTFTALSNGIFKSCLHRAVVNNVTVRKSLAFFLCPKLDKVVKPPNTLIDSKNPRAEESEIIGVDNARCSEGGTWFFMILKRFSTLIITIEFKMGYVKALTVTNMQIIITKIECRIGQSCKIRYDVLFCAGVGKPSRNRSISNSKVSRGLLGTTAKLGTIGSCVTETGAQLTADMLLSRPLPSPELRLEPSPSAASIEEEDRNALRKSKERSQGDGDVSFCSAREETDARGKVDERERKKRKVVREGDAGGRVDERERKKRKIVFGGFVLSY

SEQ ID NO: 689 - protein, 381 aa, Physcomitrella patens
  misc_feature (1)..(381): Public GI ID no. 159902531
  misc_feature (232)..(328): Pfam Name: 2OG-FeII_Oxy Pfam Description: 2OG-Fe(II) oxygenase superfamily
  misc_feature (1)..(381): Bit score of 255.8 for HMM based on sequences of Figure 1
  misc_feature (1)..(381): Functional Homolog Of SEQ ID NO. 471
MAAHPISSHSHNAADLAAVLTNTNTTLRNASLLSALALVQQLPAMFVEAEDQRPVLEMDGDPLAFSHLIPIVDMSLLKSSDPAVRASSVADIAAACEKFGFFQVVNHGVDESLIRRCETEAHTMFELPLDVKERVHRPPGTSFGYGANTWVNQTVMHWAESFHMQLHPKSNIREFSGKLFAESDPTKFSSTVEEYMGQIEKLARQLLELLTEGLGLEPTTFNHYVENERMMSMRFNLYPPCPQPELAIGLRAHTDPHLLTILHQDEVAGLQVHIDEKWITVKPRPDCFVVNVGDLFQVLSNTRYKSVLHRAAVNGTSKRLSLACFLNPPLSATVEAPPELITAERPQVYRPFTWGEYLSNAYKFHPAMGGERHERFFLERS

SEQ ID NO: 690 - protein, 379 aa, Nicotiana tabacum
  misc_feature (1)..(379): Public GI ID no. 3402332
  misc_feature (224)..(320): Pfam Name: 2OG-FeII_Oxy Pfam Description: 2OG-Fe(II) oxygenase superfamily
  misc_feature (1)..(379): Bit score of 737.7 for HMM based on sequences of Figure 1
  misc_feature (1)..(379): Functional Homolog Of SEQ ID NO. 471
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLVPKKDKVVSPPNELVDTNNPRIYPDFTWPTLLEFTQKHYRADMNTLQTFSNWLKQKTAQV

SEQ ID NO: 691 - protein, 334 aa, Sphingobium japonicum
  misc_feature (1)..(334): Public GI ID no. 294011471
  misc_feature (1)..(334): Sphingobium japonicum UT26S
  misc_feature (191)..(291): Pfam Name: 2OG-FeII_Oxy Pfam Description: 2OG-Fe(II) oxygenase superfamily
  misc_feature (1)..(334): Bit score of 87.9 for HMM based on sequences of Figure 1
  misc_feature (1)..(334): Functional Homolog Of SEQ ID NO. 471
MTRAATTARQPDPIEFRRNRVSQSVPGQVPVLSLANMARADFAAAFGGSFQRFGFAMVKDHGMDQALIDRGWALARRFFALPEEVKRRYDARYNGGQRGYTAFGVEIAKGASENDLKEFWHVGRDLPEGDPLARSMPPNVWPEELPEFRETFSRLYAEFDRVGADLLSAIALYLGLEERWFDKPVENGNSILRLLHYPPVSPQAPGIRAGAHEDINLITLLLGAEEGGLELKDRDGNWLPVVPPPGALAINVGDMLQRLTNHRLPSTSHRVVNPPPERRGYSRYSMPFFLHLRPDFLIDALPQCVDADHPRRDPPITAHDYLTERLREIGLIKG

SEQ ID NO: 692 - protein, 390 aa, Torenia fournieri
  misc_feature (1)..(390): Public GI ID no. 320462774
  misc_feature (231)..(328): Pfam Name: 2OG-FeII_Oxy Pfam Description: 2OG-Fe(II) oxygenase superfamily
  misc_feature (1)..(390): Bit score of 659.0 for HMM based on sequences of Figure 1
  misc_feature (1)..(390): Functional Homolog Of SEQ ID NO. 471
MPITCAINHTSTSTPHPTNSTKINDLKRSMIFDATLLNHESNIPPQFVWPDHEKPSSNPPELEVPFIDMGGFLSGDPAASRRASELVGEACKKHGFFLVVNHGVDRELISLAHLCMDRFFQQPLCKKQMAQRRVGEHCGYASSFTGRFSSKLPWKETLSFEYSPIDREGSSPIVEDYFVRTLGEDYGHLGRVYQDYCDAMNKLSLGIMELLGVSLGVTRTCFRDFFEQNESIMRLNYYPPCQKPDQTLGTGPHCDPTSLTILHQDTVGGLQVFVDQEWRSIRPNINAFVVNIGDTFMALSNGIYKSCLHRAVVNDQTARKSLAFFLCPKKDRVVSPPHGLLGCSNPARMYPDFRWPSLLEFTQKHYRADMDTLMFFSKWIIERKKQEQET

SEQ ID NO: 693 - protein, 363 aa, Ricinus communis
  misc_feature (1)..(363): Public GI ID no. 255556243
  misc_feature (206)..(302): Pfam Name: 2OG-FeII_Oxy Pfam Description: 2OG-Fe(II) oxygenase superfamily
  misc_feature (1)..(363): Bit score of 204.0 for HMM based on sequences of Figure 1
  misc_feature (1)..(363): Functional Homolog Of SEQ ID NO. 471
  misc_feature (17)..(17): Xaa is any aa, unknown, or other
MGEVDPAFIQALEHRPXHRPNVENIKAEGIPTFDLALLNSSDATLDNPKLLDDLVRNLGSACKNWGFFQVINHGVPLEKRERIFAASREFFGQSLEEKNKVRRGEKKVLGYYDTEHTKNVRDWKEVFDFTLENPTLVPASSKLDDDEVTKWNNQWPEYPPELREICEEYAKEMEKLAYKLTELIALSLGLEPDRFHGFFKGQTTFIRLNHYPPCPIPDLALGVGRHKDAGALTILAQDDVGGLEVKTKSGEWTWIKPTSNSYIINVGDIIQVWSNDAYESVEHRVKVNSERERFSIPFFFNPAHYTMVKPLEEILDEQNPAKYKPYSWGKFLVTRKRSNFKKLDAENVQIYHFRVSEFADINS

SEQ ID NO: 694 - DNA, 1149 bp, Populus trichocarpa
  misc_feature (1)..(1149): Ceres Annot ID no. 1456250
  misc_feature (1)..(1149): Encodes the peptide sequence at SEQ ID NO. 695
atgtctctcctaatggactcaacttcttcaagtcttctcttgtgtcctcctccgtatcttacaaaagatgaaactggggctcttgtttttgactcatctttcttgcaaaaacaagccagcttgcccacagagttcatgtggccacatggagacttagttcacaacgaagatgagcttaaagagccaatgatagacttggaaggattccttaaaggtgatgaggttgcaactgctcaagctgctgagcttgttaggactgcttgcttgaaccatggcttctttcaagtcaccaaccatggtgttgatataagtctcattcatagtgctcatgaagagattggcaagattttcaaactgcctcttgacaagaaactcagtgtccgtagaaagccaggtgatgtgagtggatattctggtgcccatgcacatcgatattcatccaagttgccatggaaggagacattttcttttggctaccacggggatgatgattctgtgccacttgttgttgactacttcaagtccgtcttaggaaaagattttgaacacactgggtgggtttaccaaagttactgtgaagcaatgaagaaagtatccctagtgatatttgagctgttggccatcagcctaggagttgatcgtttacactatcgcaaattctttgaagatggaagctcaataatgaggtgtaactattatccaccttgcaataattctaccctcactcttggcactggtcctcactgtgacccaacttccttaacaatacttcaccaagaccaagttggtggtcttcaagtcttttcaaacaacaaatggctagcaatccgacctcgtccagatgccctagttgtaaacattggtgataccttcatggcactatccaatgggagatacaaaagttgccttcatagagcagtggtgaacagggacagcgagagaagatcactggttttctttgtgagtccaaaagaggaaaaagtagtgagacccccacaagatcttgtttccagagaagggcaaaggatttacccggatttcacatggtcggatttgttggagttcacgcaaaagcactacagagctgatgtcgctacactccaaagcttcattcaatggctttcatcttctaaaccatctaccttttag

SEQ ID NO: 695 - protein, 382 aa, Populus trichocarpa
  misc_feature (1)..(382): Ceres Annot ID no. 1456250
  misc_feature (226)..(323): Pfam Name: 2OG-FeII_Oxy Pfam Description: 2OG-Fe(II) oxygenase superfamily
  misc_feature (1)..(382): Bit score of 540.9 for HMM based on sequences of Figure 1
  misc_feature (1)..(382): Functional Homolog Of SEQ ID NO. 471
MSLLMDSTSSSLLLCPPPYLTKDETGALVFDSSFLQKQASLPTEFMWPHGDLVHNEDELKEPMIDLEGFLKGDEVATAQAAELVRTACLNHGFFQVTNHGVDISLIHSAHEEIGKIFKLPLDKKLSVRRKPGDVSGYSGAHAHRYSSKLPWKETFSFGYHGDDDSVPLVVDYFKSVLGKDFEHTGWVYQSYCEAMKKVSLVIFELLAISLGVDRLHYRKFFEDGSSIMRCNYYPPCNNSTLTLGTGPHCDPTSLTILHQDQVGGLQVFSNNKWLAIRPRPDALVVNIGDTFMALSNGRYKSCLHRAVVNRDSERRSLVFFVSPKEEKVVRPPQDLVSREGQRIYPDFTWSDLLEFTQKHYRADVATLQSFIQWLSSSKPSTF

SEQ ID NO: 696 - protein, 387 aa, Torenia fournieri
  misc_feature (1)..(387): Public GI ID no. 320462772
  misc_feature (227)..(324): Pfam Name: 2OG-FeII_Oxy Pfam Description: 2OG-Fe(II) oxygenase superfamily
  misc_feature (1)..(387): Bit score of 701.1 for HMM based on sequences of Figure 1
  misc_feature (1)..(387): Functional Homolog Of SEQ ID NO. 471
MTTNHTITASSETKSHSQPLTKDQENSLIFDATLLNHQSNIPPQFIWPDHEKPCSNPPELKVPLIDLGSFLSGDPSASLRASELVGEACRKHGFFLVVNHGVDPSLVSDAHRYMDRFFEQPLSEKQRAQRKLGEHCGYASSFTGRFSSKLPWKETLSFEYSPRSDSSRIVEEYFERKLGENFAHLGKVYQDYCDAMSKLSLGIMELLGMSLGVNRSYFKDFFQGNESIMRLNYYPPCQKPDQTLGTGPHCDPTSLTILHQDTVGGLQVFVDDEWRSIRPNFDAFVVNIGDTFMALSNGRYRSCLHRAVVNDKRTRKSLAFFLCPKKDKLVSPPCELVDTENPRIYPDFRWLNLLEFTQKHYRADMNTLSFFSKWVVEQQQKTSELVM

SEQ ID NO: 697 - protein, 439 aa, Brassica nigra
  misc_feature (1)..(439): Public GI ID no. 187729689
  misc_feature (300)..(384): Pfam Name: 2OG-FeII_Oxy Pfam Description: 2OG-Fe(II) oxygenase superfamily
  misc_feature (1)..(439): Bit score of 85.7 for HMM based on sequences of Figure 1
  misc_feature (1)..(439): Functional Homolog Of SEQ ID NO. 471
  misc_feature (26)..(26): Xaa is any aa, unknown, or other
  misc_feature (31)..(31): Xaa is any aa, unknown, or other
  misc_feature (102)..(102): Xaa is any aa, unknown, or other
  misc_feature (310)..(310): Xaa is any aa, unknown, or other
MGADTPQLPVIYLSDQTLKPGSEKWXEVRSXVRKALEEYGAFEVSYDRVTEELKKSVLDAMIELFELPVEAKQRNVSPKPYMGYSTHNGLSESLGIQDPNVXEKVNEFTQLLRPDCEGNKSMSETIQKFSEKLVELDVTVKRMVIQSFGIENYFDEHLKSLKNYRMRLMKYVAPPDVDAKDADDGANTNLNANADADAGAGDIANGIANVHIDEDVNAKGDVGTGGGDANHNGDDANTGDSASVKSNVDVGTDVNVKASVGADVNVGTIADANANIGTLSSANVGVGDSVKANGGADDEEKKLGLPSHTXKSLLTVLYQYEIDGLEVLTKDEKWIRCKPAHNSFVVIAGDSLYALMNGRLSRPFHRVRVTERKKTRYSIALFSAPDGDYIIEPPKELVDEKHPRLFKPFTYADLMSFYHTEAGRRSRSTLHAYCAVSGA

SEQ ID NO: 698 - protein, 317 aa, Maricaulis maris
  misc_feature (1)..(317): Public GI ID no. 114570248
  misc_feature (1)..(317): Maricaulis maris MCS10
  misc_feature (172)..(274): Pfam Name: 2OG-FeII_Oxy Pfam Description: 2OG-Fe(II) oxygenase superfamily
  misc_feature (1)..(317): Bit score of 72.0 for HMM based on sequences of Figure 1
  misc_feature (1)..(317): Functional Homolog Of SEQ ID NO. 471
MPSDTLSRFAPVSMALAHTDKARFAAELGRSFREFGFAAISDHGLDPALIQAAYDKAAQFFALPEETKLAYLVEGGGGARGYTPFGKEIAKDAKHVDLKEFWHVGRDLPAGHKYEADMAPNLVPAEVEGWRETVHGLYGAFDALGVQVLRAIALDLGLEETFFDDTVKDGNSVMRLLHYPPVTGDPGGSIRAEAHGDINTITLLLGAEEPGLQVMTRDGEWIDMNPPPGCLVVNMGDMLARSTNDVLPSTQHRVINPAGARTGFSRYSLPFFLHYRPDYMIETLPGCAGPDNPDKYPEPMRANDFLNQRLREIGLLK

SEQ ID NO: 699 - protein, 388 aa, Gossypium hirsutum
  misc_feature (1)..(388): Public GI ID no. 74273643
  misc_feature (228)..(326): Pfam Name: 2OG-FeII_Oxy Pfam Description: 2OG-Fe(II) oxygenase superfamily
  misc_feature (1)..(388): Bit score of 602.6 for HMM based on sequences of Figure 1
  misc_feature (1)..(388): Functional Homolog Of SEQ ID NO. 471
MVHCLPKVFVIQDKPILPSTAAVAKDEYWPPLAFDASILGSESNIPSQFIWPDDEKPCLDAPELVIPTIDLGAFLLRYSLAVSKAAEVVNEACKKHGFFLVVNHGVDSGLIDKAHQYMDRFFSLQLSEKQKAKRKVGESYGYASSFVGRFSSKLPWKETLSFRYCPRTQNIVQHYMVNLMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPYPGAFVVNVGDTFMALTKAFYKSCLHRAVVNTETVRKSLRFFLCPKLERPVTPAAGLVTAENPRKYPDFTWAALLKFTQNHYRADMKTLVAFSKWVQEQESNYKLIP

SEQ ID NO: 700 - protein, 228 aa, Aspergillus niger
  misc_feature (1)..(228): Public GI ID no. 317029127
  misc_feature (1)..(228): Aspergillus niger CBS 513.88
  misc_feature (87)..(170): Pfam Name: 2OG-FeII_Oxy Pfam Description: 2OG-Fe(II) oxygenase superfamily
  misc_feature (1)..(228): Bit score of 48.0 for HMM based on sequences of Figure 1
  misc_feature (1)..(228): Functional Homolog Of SEQ ID NO. 471
MYGKLEDGRCHSRLHPDVISISQEQIRQFIEHAHAVLDEVLAKLDTCLGIESQTLEALSPLDQESDGIVRLLWSPAQTNPNYDRILFGGHTDMGTMTLLFNIAGGLQVLPAGCENCKENWRYIKPEPGCAVVNVGDTLVEWTGGLLRSSLHRVVTAPGDQAMVQRHSVAYLVRAKRNASLQRLKGGTIPPLAPGEEDETRSVDEWNEWKSRQIVLGQLKPETRGGRNM

SEQ ID NO: 701 - protein, 379 aa, Pisum sativum
  misc_feature (1)..(379): Public GI ID no. 1381673
  misc_feature (224)..(322): Pfam Name: 2OG-FeII_Oxy Pfam Description: 2OG-Fe(II) oxygenase superfamily
  misc_feature (1)..(379): Bit score of 633.0 for HMM based on sequences of Figure 1
  misc_feature (1)..(379): Functional Homolog Of SEQ ID NO. 471
MKVLCSSMLFAPPNANESFMNEQKQCLDNTSSLPLQITNIPSEFIWPDHEKPCLTPPKLEVPPIDLKAFLSDDPKSISNACSKVNHACKKHGFFLVVNHGVDNKLIAQAHKLVDEFFCMQLSEKQRAQRKIGEHCGYANSFIGRFSSKLPWKETLSFRYSADESCRTVEDYFVNIMGEDFRQFGIVYQKYCEAMSNLSLGIMELLGMSLGVGKEYFREFFEGNESVMRLNYYPPCKNPDLAFGTGPHCDPTSLTILHQDQVEGLQVLVDGIWHSVVPKEDAFVVNIGDTFMALSNGMFKSCLHRAIVNDKIVRKSLAFFLCPNEDKIVTPPKELIDKENPRKYPNFTWPSLLEFTQKHYRADERTLDAFSMWLQEKTTT

SEQ ID NO: 702 - protein, 318 aa, Aspergillus oryzae
  misc_feature (1)..(318): Public GI ID no. 317158331
  misc_feature (1)..(318): Aspergillus oryzae RIB40
  misc_feature (170)..(271): Pfam Name: 2OG-FeII_Oxy Pfam Description: 2OG-Fe(II) oxygenase superfamily
  misc_feature (1)..(318): Bit score of 55.8 for HMM based on sequences of Figure 1
  misc_feature (1)..(318): Functional Homolog Of SEQ ID NO. 471
MDKTDIAHLEVLSFAKLASKDQTELNKLLDACRKQGFFYLDLAGSNVSHGLHQRLKALSLMKDWFDRPNEEKMKLHKDSVTNGYKPPGTLSGVVKHMKDGFENIKLPRDNFLGTGDSLPEVFKNDKEVFRDDLEISHGVTLTILSCLSDLLQPPVRLEDYHQENMSSQSTMMYFRYAKQCADKSSGVGHNMHTDLGTLTLLYCEQWGLQVYAQATNSWKYVQPRPGLYVVNVGDALRFLSGNDLLSALHRVVPVPGHESEYRYSTAYFLRPGNETEFRTSENTVVSALNWHDQKYNVFKAAHVEQEKNTILTGGIGAF

SEQ ID NO: 703 - protein, 324 aa, Physcomitrella patens
  misc_feature (1)..(324): Public GI ID no. 168041562
  misc_feature (1)..(324): Physcomitrella patens subsp. patens
  misc_feature (175)..(271): Pfam Name: 2OG-FeII_Oxy Pfam Description: 2OG-Fe(II) oxygenase superfamily
  misc_feature (1)..(324): Bit score of 250.9 for HMM based on sequences of Figure 1
  misc_feature (1)..(324): Functional Homolog Of SEQ ID NO. 471
MDGDPLAFSHLIPIVDMSLLKSSDPAVRASSVADIAAACEKFGFFQVVNHGVDESLIRRCETEAHTMFELPLDVKERVHRPPGTSFGYGANTWVNQTVMHWAESFHMQLHPKSNIREFSGKLFAESDPTKFSSTVEEYMGQIEKLARQLLELLTEGLGLEPTTFNHYVENERMMSMRFNLYPPCPQPELAIGLRAHTDPHLLTILHQDEVAGLQVHIDEKWITVKPRPDCFVVNVGDLFQVLSNTRYKSVLHRAAVNGTSKRLSLACFLNPPLSATVEAPPELITAERPQVYRPFTWGEYLSNAYKFHPAMGGERHERFFLERS

SEQ ID NO: 704 - DNA, 1230 bp, Glycine max
  misc_feature (1)..(1230): Ceres Clone ID no. 1647898
  misc_feature (1)..(1230): Encodes the peptide sequence at SEQ ID NO. 705
agagttccttaattccttccttaattgactgaaacaacacaattaacgtgagacgatggattcaggtggtctcttgcggtgtgaactagaggttctgccccacgtgccaaccaatttcatttggccaaaggagtacttggtggatgcacaacacgagctccaagcaccagtggtggacctttatggctttctcagaggggaaaacgaggctacaaaacatgctgctaagctcataagtgaagcttgcttgaaacatggcttcttccaagtgatcaaccacggggttgatccacacctcattcgtcaagcacatgatcaaatggacactttcttcaagctcccaattcataggaaattgagtgttcataagacacccggttccatgtggggctactctggtgcacatgctcatcgcttctcctcccaattgccatggaaggaaaccctctctttcccataccatgacaacaccttagagcctgttgtaacaaactacttcaaatccaccataggagaagactttgaacaaaccggagagacattccagaaatactgtggagctatgaagcaattgggaatgaaactgatagagctattggcaatgagcttaggcgtggatcggttgcattatagggacttgtttgaagaagggtgctctatcatgagatgcaacaattacccatcttgccaacaaccgagcctcacactcgggacaggaccacactgtgatccaacgtcgttaaccatacttcaccaagatcatgttggaggccttcatgtatttgcagacaacaaatggcagacggttcctcctcgtctggatgcatttgtagtgaacattggagacaccttcacggcattatcgaatgggagatacaaaagttgcctccatagggcagtggtgaacaagtacaaggagaggaagtccttggcgttctttctatgcccaaaagaagacaagttggtgagagccccaaatgatattgtgagcatggatggcaccaaacactatcccgattttacatggtcacatttgcttcacttcacgcaaaaccactatagagcagaccaagctacactaccaaacttcaccaagtggttgttatcctccaaaaccacacacactagctagccagcttttatgcaaaccaactaataaatttggttgttctattttttttttatatgtattatttaaccaactgaattataactctttgatgttgttct

SEQ ID NO: 705 - protein, 358 aa, Glycine max
  misc_feature (1)..(358): Ceres Clone ID no. 1647898
  misc_feature (201)..(298): Pfam Name: 2OG-FeII_Oxy Pfam Description: 2OG-Fe(II) oxygenase superfamily
  misc_feature (1)..(358): Bit score of 501.7 for HMM based on sequences of Figure 1
  misc_feature (1)..(358): Functional Homolog Of SEQ ID NO. 471
MDSGGLLRCELEVLPHVPTNFIWPKEYLVDAQHELQAPVVDLYGFLRGENEATKHAAKLISEACLKHGFFQVINHGVDPHLIRQAHDQMDTFFKLPIHRKLSVHKTPGSMWGYSGAHAHRFSSQLPWKETLSFPYHDNTLEPVVTNYFKSTIGEDFEQTGETFQKYCGAMKQLGMKLIELLAMSLGVDRLHYRDLFEEGCSIMRCNNYPSCQQPSLTLGTGPHCDPTSLTILHQDHVGGLHVFADNKWQTVPPRLDAFVVNIGDTFTALSNGRYKSCLHRAVVNKYKERKSLAFFLCPKEDKLVRAPNDIVSMDGTKHYPDFTWSHLLHFTQNHYRADQATLPNFTKWLLSSKTTHTS

SEQ ID NO: 706 - protein, 352 aa, Physcomitrella patens
  misc_feature (1)..(352): Public GI ID no. 168004189
  misc_feature (1)..(352): Physcomitrella patens subsp. patens
  misc_feature (194)..(290): Pfam Name: 2OG-FeII_Oxy Pfam Description: 2OG-Fe(II) oxygenase superfamily
  misc_feature (1)..(352): Bit score of 251.8 for HMM based on sequences of Figure 1
  misc_feature (1)..(352): Functional Homolog Of SEQ ID NO. 471
MHKVQELPPMFVEAEDQRPVLEMEAKASDMIPIVDLSLLNSDDPAVRNALVADIAEACEKFGFFQVMNHGVEESLIRRCEAEAHTMFELPLEVKERVHRPPQTSFGYGANTWVNQTVMHWAESFHMQLYPKSNIREFSSKLFAESDPTKFSSTVEEYMAKIETLARQLLELLTEGLGLEPTLFNHYVEQERMMSMRFNLYPPCPQPDLAIGLRAHTDPHLLTILHQDEIAGLQVHIDDQWITVKPRPNCFVVNVGDLFQVLSNTKYKSVLHRAAVNGTSKRLSLACFLNPPLSATVEAPPELITPERPQVYRPFTWGEYLSNAYKFHPATGGTHILDMAFLANKHFSQHNQN

SEQ ID NO: 707 - protein, 379 aa, Physcomitrella patens
  misc_feature (1)..(379): Public GI ID no. 195976671
  misc_feature (1)..(379): Physcomitrella patens subsp. patens
  misc_feature (217)..(314): Pfam Name: 2OG-FeII_Oxy Pfam Description: 2OG-Fe(II) oxygenase superfamily
  misc_feature (1)..(379): Bit score of 258.0 for HMM based on sequences of Figure 1
  misc_feature (1)..(379): Functional Homolog Of SEQ ID NO. 471
MAAFVSDGNSTINAGLLAAILKDSKQLPEMFIESDQNHRPSLESASLEDPDLDIPVLDLSFLAAGNSTQRAEVVAAAAKACQTWGFFQIQNHGIDQKLIVQCEEEAHRMFQLPLDVKERCHRAPGATFGYGANTWINQKVMHWAESFHMQLNPTSNIREMASKLFPEGSSSQQFSSVVEEYMIAVENLASQVLEILTEGLGLEPSCFSQYLRRERMTSMRFNFYPPCPEPSLAIGLRAHTDPHLLTILHQDSVPGLQVQMGDKWITVKPRPDCFVVNIGDLFQILSNTRYKSVLHRAIVNSESRRLSLACFLNPPLNSTVVAPPELITPECPQVYRPFTWLEYLKNAYLYHPTAGNERHERFFLKTMVDVHTVAPSSVH

SEQ ID NO: 708 - protein, 326 aa, Physcomitrella patens
  misc_feature (1)..(326): Public GI ID no. 168033355
  misc_feature (1)..(326): Physcomitrella patens subsp. patens
  misc_feature (179)..(273): Pfam Name: 2OG-FeII_Oxy Pfam Description: 2OG-Fe(II) oxygenase superfamily
  misc_feature (1)..(326): Bit score of 224.3 for HMM based on sequences of Figure 1
  misc_feature (1)..(326): Functional Homolog Of SEQ ID NO. 471
MRPTVTHNDYTDLEIPVIDVSALFDPPQHDEKVMEGLVAQVRDACLHWGFFQIVNHGIPEELLERFHGQGKQFFALPFAEKMKVARQQGQYTGYGHATVKKGDVRPWSEGFYFANDGSTAEFAKKLWPEDTNDDFLNSYSEYNEKVQGLSECLMRIIVDGLDVDPAYFETFSKHAGGLLRWNFYPACPEPQKTLGLKPHTDFNLLTVLHQGDVGGLQIEKDGKWIPVRPRPGALAVNIGDTLQVLTNGKYKSVPHQAVVNATQSRISSAYFYEALPSTVIVPHPDLVDENNPLQYEPFTGEAYRVYKQTQFLNTLEHFVRKKPDAE

SEQ ID NO: 709 - protein, 352 aa, Glycine max
  misc_feature (1)..(352): Public GI ID no. 255637063
  misc_feature (200)..(298): Pfam Name: 2OG-FeII_Oxy Pfam Description: 2OG-Fe(II) oxygenase superfamily
  misc_feature (1)..(352): Bit score of 230.2 for HMM based on sequences of Figure 1
  misc_feature (1)..(352): Functional Homolog Of SEQ ID NO. 471
MGEVDAAFIQDPPHRPKLSTIQAEGIPIIDLSPITNHRVSDPSAIEGLVKEIGSACNEWGFFQVTNHGVPLTLRQNIEKASKLFFAQSAEEKRKVSRNESSPAGYYDTEHTKNVRDWKEVFDFLAKEPTFIPVTSDEHDDRVNQWTNQSPEYPLNFRVVTQEYIQEMEKLSFKILELIALSLGLEAKRFEEFFIKDQTSFIRLNHYPPCPYPDLALGVGRHKDPGALTILAQDGVGGLEVRRKADQEWIRVKPTPDAYIINIGDTVQVWSNDAYGSVDHRVVVNSEKERFSIPFFFFPAHDTEVKPLEELINEQNPSKYRPYKWGKFLVHRGNSNFKKQNEENIQIYHYKIA

SEQ ID NO: 710 - protein, 370 aa, Phaseolus coccineus
  misc_feature (1)..(370): Public GI ID no. 218764876
  misc_feature (216)..(314): Pfam Name: 2OG-FeII_Oxy Pfam Description: 2OG-Fe(II) oxygenase superfamily
  misc_feature (1)..(370): Bit score of 599.8 for HMM based on sequences of Figure 1
  misc_feature (1)..(370): Functional Homolog Of SEQ ID NO. 471
MLIPHPSMLLASQNTNIEPQQINLQAPTPNQSNIPSEFVWPDNEKPCLEPPKLKIPPIDIKGFLSGDPETVSAICAEVNEACRKHGFFLVVNHGVDKKLVEKAHKLIDTFFCMELPEKQKLQRKLGEHWGYANSFIGRFSSKLPWKETLSFHYAPDTKTVEDYFLNSMGEEFREFGSFFQEYCEVMSNLSLEIMELLGMSLGVSRECFRDFFENNESVMRLNYYPPCHKPELALGTGPHCDPTSLTVLHQDQVEGLQVFVDGKWCSVAPKEDAFVVNIGDTFMALSNGIFKSCLHRAVVNNQIVRKSLAFFLCPNKDKVVSAPKELITVENPKKYPDFTWPNLLEFTQLHYRSDPETLDAFANWVLEKNK

SEQ ID NO: 711 - protein, 387 aa, Gossypium hirsutum
  misc_feature (1)..(387): Public GI ID no. 47499085
  misc_feature (227)..(325): Pfam Name: 2OG-FeII_Oxy Pfam Description: 2OG-Fe(II) oxygenase superfamily
  misc_feature (1)..(387): Bit score of 617.3 for HMM based on sequences of Figure 1
  misc_feature (1)..(387): Functional Homolog Of SEQ ID NO. 471
MVHCLPKVFVIQDKPMLPSTAAVAKDEHRPLAFDASILGSESNIPSQFIWPDDEKPCLDAPALVIPTIDLGAFLLGDSLAVSKAAEVVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPIPGAFVVNVGDTFMALTNGFYKSCLHRAVVNTETVRKSLAFFLCPKLERPVTPAAGLVTAENPRKYPDFTWAALLKFTQNHYRADMKTLVAFSKWVQEQESNYKLIP

SEQ ID NO: 712 - protein, 354 aa, Rhodococcus erythropolis
  misc_feature (1)..(354): Public GI ID no. 229489577
  misc_feature (1)..(354): Rhodococcus erythropolis SK121
  misc_feature (186)..(290): Pfam Name: 2OG-FeII_Oxy Pfam Description: 2OG-Fe(II) oxygenase superfamily
  misc_feature (1)..(354): Bit score of 101.3 for HMM based on sequences of Figure 1
  misc_feature (1)..(354): Functional Homolog Of SEQ ID NO. 471
MPSSQSDPFEVPVVDISPYVLGGADQDKARVAAEVDHACRTVGFMQIRGHGVPAAVSSGLAEAMDDFFGLPMETKSGYRIEGANRGYSPPKSESLSLSLGVESATRMNDFFEAFNVGTEARSFTELELSEDDYGINLWPAVSGFTERVENYYAHGERVARTLTTIFEDALGLTPGFFESITDHSIDVLRMNNYALPEGTVALDGELKGMGEHTDFGLVTVLWADQVEGLQVLGSDRRWHDVWPHDGALLVNLGDLTARLTNDRWMSTLHRVAPPVVNGTIKRRRSAAFFHDGNVDAVIATLPSFQDDSGLEYEPITVRDHIKAKLAGSRQGKSNAAAGREAARVLSAAELEVKQ

SEQ ID NO: 713 - protein, 385 aa, Populus tremula
  misc_feature (1)..(385): Public GI ID no. 53139616
  misc_feature (230)..(328): Pfam Name: 2OG-FeII_Oxy Pfam Description: 2OG-Fe(II) oxygenase superfamily
  misc_feature (1)..(385): Bit score of 733.1 for HMM based on sequences of Figure 1
  misc_feature (1)..(385): Functional Homolog Of SEQ ID NO. 471
MAIDCIKSMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKFPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 714 - protein, 311 aa, Caulobacter crescentus
  misc_feature (1)..(311): Public GI ID no. 16124455
  misc_feature (1)..(311): Caulobacter crescentus NA1000
  misc_feature (168)..(269): Pfam Name: 2OG-FeII_Oxy Pfam Description: 2OG-Fe(II) oxygenase superfamily
  misc_feature (1)..(311): Bit score of 84.2 for HMM based on sequences of Figure 1
  misc_feature (1)..(311): Functional Homolog Of SEQ ID NO. 471
MSTSAIDPVSFSLYAKDFTRFAQELGASFERYGFAVLSDYDLDQARIDAAVDSAKAFFALPVETKKQYAGVKGGARGYIPFGVETAKGADHYDLKEFWHMGRDLPPGHRFRAHMADNVWPAEIPAFKHDVSWLYNSLDGMGGKVLEAIATYLKLERDFFKPTVQDGNSVLRLLHYPPIPKDATGVRAGAHGDINTITLLLGAEEGGLEVLDRDGQWLPINPPPGCLVINIGDMLERLTNNVLPSTVHRVVNPPPERRGVPRYSTPFFLHFASDYEIKTLQNCVTAENPDRYPESITADEFLQQRLREIKLA

SEQ ID NO: 715 - protein, 337 aa, Chromohalobacter salexigens
  misc_feature (1)..(337): Public GI ID no. 92115002
  misc_feature (1)..(337): Chromohalobacter salexigens DSM 3043
  misc_feature (187)..(293): Pfam Name: 2OG-FeII_Oxy Pfam Description: 2OG-Fe(II) oxygenase superfamily
  misc_feature (1)..(337): Bit score of 95.5 for HMM based on sequences of Figure 1
  misc_feature (1)..(337): Functional Homolog Of SEQ ID NO. 471
MTQTSIPHIDLTPLLEGAGSDDPAHADSVAAIVDAACRSGFMTVGIAPGQLALPDDIHARLLRFFELDAAAKQRLARHKFEPANGNVYRGYFPPQNEDPTWKEGIDLGADVAHPERADAASGDPLREPTPQPPAASLPGWSDDVAAYYTAMESLGGVIAAALAEGLGMPRNTLMQPFENGNSTLRLIHYPERPAETLASMPAVDGQGDARRRMVGVPHCDNGFITLLWQDRVGGLQVQTPDGDWEDVAPRDNALVVNFGRLLSDWSGGRIQATEHRIVGGTRSRHSIPFFFEPAVEATIEAPNADGDGGYVYGDRLWQRMQAFVEFQGLERAPAARD

SEQ ID NO: 716 - protein, 343 aa, Gordonia bronchialis
  misc_feature (1)..(343): Public GI ID no. 262200288
  misc_feature (1)..(343): Gordonia bronchialis DSM 43247
  misc_feature (181)..(275): Pfam Name: 2OG-FeII_Oxy Pfam Description: 2OG-Fe(II) oxygenase superfamily
  misc_feature (1)..(343): Bit score of 59.4 for HMM based on sequences of Figure 1
  misc_feature (1)..(343): Functional Homolog Of SEQ ID NO. 471
MFTVPTVDIAPYVDPNGSPEDRQRVAEELDNACSGVGFIQIVGHGIDTAVVERLTAALDEFYALPLEVKKQYARPGENRGYSPPKSESLSMSLGVAAANQMNDFYEAFTVGSERSWFPGHDLPETSYPDNTWPGAAPGFRPAVQEWFTAARGLSRVLLTAFTDDLGLAPGYFDAMTDHSIDALKLNNYTLPEGDIELAGELTGMGAHTDFGILTELWADQVPGLQVLDHDGCWHDVAPADGALLVNLGDAMARWTNDRWRSTIHRVDPPVVDGRILRRRSAAFFFDGNSDAVIETLPGCARTDHPGYPPITVAENIDAKLAGMKGGIAPVAADREARRVMAAS

SEQ ID NO: 717 - protein, 385 aa, Populus tremula
  misc_feature (1)..(385): Public GI ID no. 53139668
  misc_feature (230)..(328): Pfam Name: 2OG-FeII_Oxy Pfam Description: 2OG-Fe(II) oxygenase superfamily
  misc_feature (1)..(385): Bit score of 732.7 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFRNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 718 - protein, 377 aa, Nicotiana sylvestris
  misc_feature (1)..(377): Public GI ID no. 20149241
  misc_feature (221)..(318): Pfam Name: 2OG-FeII_Oxy Pfam Description: 2OG-Fe(II) oxygenase superfamily
  misc_feature (1)..(377): Bit score of 705.1 for HMM based on sequences of Figure 1
  misc_feature (1)..(377): Functional Homolog Of SEQ ID NO. 471
MTVDCMITRNKFTMQRTSKEPLIFDASVMKNESNIPSQFIWPDNEKPCANARELHVPHIDLGGVLSGDPFATKQAATLVNEACQKHGFFLVINHGIDTNLISNAHRYMDLFFELPLNEKQKAQRKIGEHCGYASSFTGRFSSKLPWKETLSFQYSAEEGSSHIVEDYFQRTMGENFCHLGKVYQDYSIAMSTLSLGIMELLGLSLGVSRNHFKEFFQENESIMRLNYYPPCQKPELTFGTGPHCDPTSFTILHQDSVGGLQVFVDNEWRSITPNFNAFVVNIGDTFMALSNGRYKSGLHRAVVNTKIPRKSLAFFLCPKKDKVVSPPIELVDSNNPRIYPEFTWPALLEFTQKQYRVDMNTLQTFSNWVQQTTTQAL

SEQ ID NO: 719 - protein, 358 aa, Achromobacter xylosoxidans
  misc_feature (1)..(358): Public GI ID no. 311109251
  misc_feature (1)..(358): Achromobacter xylosoxidans A8
  misc_feature (205)..(298): Pfam Name: 2OG-FeII_Oxy Pfam Description: 2OG-Fe(II) oxygenase superfamily
  misc_feature (1)..(358): Bit score of 113.7 for HMM based on sequences of Figure 1
  misc_feature (1)..(358): Functional Homolog Of SEQ ID NO. 471
MTTATNQVSASEGVKQAIESGQGLPILDVGPYLAGKPGALEQLAADVRWIQENLGFFAIVNHGIPQGLIDESFRQTAKLFEIPMEEKLRHRVGFHHQGYLPPKASILQSTAIMEKIALNTKKDTNAAWLFMRNRTADDPKVVANVRHRGLNQWPESLPEFRKTLYEYQTSMEALALKLLPIYARALDLPADHFNHMFKAPEYYQRCAYYHPEERLEEGQYALAPHSDGSFLTLLPMTPVPGLQVMTPSKEWLNVTYVKDALIVNTGQVLNRLSNDRFIATPHRVVNPPMKRYALTFFFYPDDDANVGPIPACVKQGEKAKYDSRSFYDFFVPYLDDLYHYNDPKFMSEVEPEGIRSQA

SEQ ID NO: 720 - protein, 387 aa, Gossypium hirsutum
  misc_feature (1)..(387): Public GI ID no. 222875432
  misc_feature (227)..(325): Pfam Name: 2OG-FeII_Oxy Pfam Description: 2OG-Fe(II) oxygenase superfamily
  misc_feature (1)..(387): Bit score of 606.8 for HMM based on sequences of Figure 1
  misc_feature (1)..(387): Functional Homolog Of SEQ ID NO. 471
MVHCLPKVFVIQDKPMLPSTAAVAKDEHRPLAFDASILGSESNIPSQFIWPDDEKPCLDAPALVIPTIDLGAFLLGDSLAVSKAAEVVNEACKKRGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPIPGAFVVNVGDTFMALTNGFYKSRLHRAVVNTETVRKSLAFFLCPKLERPVAPAAGLVTAENPRKYPDFTWAALLKFTQNHYRADMKTLVAFSKWVQEQESNYKLIP

SEQ ID NO: 721 - protein, 390 aa, Chrysanthemum x morifolium
  misc_feature (1)..(390): Public GI ID no. 190192208
  misc_feature (237)..(334): Pfam Name: 2OG-FeII_Oxy Pfam Description: 2OG-Fe(II) oxygenase superfamily
  misc_feature (1)..(390): Bit score of 724.0 for HMM based on sequences of Figure 1
  misc_feature (1)..(390): Functional Homolog Of SEQ ID NO. 471
MLTLLTLKNIICAMAIDCMIKTTSNMPSLKEDQRKSFVFDASVLKHETNLPQQFIWPDHEKPNSQKSKELEVPLIDLGGFLSGRSSSTKEASSLVGEACQKHGFFLVVNHGVDANLISDAQRYMDLFFELPLSVKQRAQRNVGESCGYASSFTGRFSSKLPWKETLSFRFSAEENASNIVKEYFENTMGEEFIRLGKVYQEYCNAMSRLSLGIMELLGMSLGVSRAYYKEFFEEHNSIMRLNYYPPCQKPDLTLGTGPHCDPTSLTILHQDNVGGLEVFVDNEWRLIVPNSNAFVVNIGDTFMALSNGRYKSCLHRAVVNSKTTRKSLAFFLCPKKDKVVIPPKELVDENNPRIYPDFTWSTFLEFTQKHYRADKNTLQAFSTWVRQKTT

SEQ ID NO: 722 - DNA, 993 bp, Glycine max
  misc_feature (1)..(993): Ceres Clone ID no. 1370404
  misc_feature (1)..(993): Encodes the peptide sequence at SEQ ID NO. 723
attcttaacactcttttgatctctcctccttctctctccacacctccaaccactctttcaaacttccaaatttcaactcttacaacatatcaaacaaaaattccatcaaataatacacacactttagctgttgttgtgcacttcaaattaattaaacatgctagttcctcatccttcaatgctaattgcacctcaaaacaccgtagaaaatcatgacaacatcatggaaggacagaaactacactttgatggatctttgatgccaaaccaatccaacataccctcccagttcatatggcctgatcatgaaaaaccatgcctaacaccaccagaactccaaattccacccattgacttgaagtgctttctctcagcagatccacaagctttgtcaacagtttgtgctgaattgagtgaggcatgcaagaagcatggcttcttccttgttgtcaaccatggagttgatagcaagctcatagctcaagctcataagctcatagatgatttcttctgcatgcaactctcacagaagcagaaggctcagagaaagattggagaacattgtggctatgctaatagcttcattggaagattctcctccaaacttccttggaaggaaacactttctttccattattctgcagataaatccagaaaaactgtggaggattatttccttaatgtcatgggggaagatttcaagcaatttgggagtgtgttccaagaatactgtgaagccatgagcaaactctctcttgggataatggagcttctggggatgagcctaggagttggcagggaatgtttcagagatttcttcgaaggaaatgagtcggttatgaggttgaattactacccaccatgccaaaaacctgagttagctttaggaactggacctcattgtgaccctacatccctaaccattctccaccaagatcaagtcgagggcctccaagtctttgttgatggaagatggtactctgtcgctcctaa

SEQ ID NO: 723 - protein, 278 aa, Glycine max
  misc_feature (1)..(278): Ceres Clone ID no. 1370404
  misc_feature (225)..(277): Pfam Name: 2OG-FeII_Oxy Pfam Description: 2OG-Fe(II) oxygenase superfamily
  misc_feature (1)..(278): Bit score of 439.7 for HMM based on sequences of Figure 1
  misc_feature (1)..(278): Functional Homolog Of SEQ ID NO. 471
MLVPHPSMLIAPQNTVENHDNIMEGQKLHFDGSLMPNQSNIPSQFIWPDHEKPCLTPPELQIPPIDLKCFLSADPQALSTVCAELSEACKKHGFFLVVNHGVDSKLIAQAHKLIDDFFCMQLSQKQKAQRKIGEHCGYANSFIGRFSSKLPWKETLSFHYSADKSRKTVEDYFLNVMGEDFKQFGSVFQEYCEAMSKLSLGIMELLGMSLGVGRECFRDFFEGNESVMRLNYYPPCQKPELALGTGPHCDPTSLTILHQDQVEGLQVFVDGRWYSVAP

SEQ ID NO: 724 - protein, 337 aa, Pseudomonas savastanoi
  misc_feature (1)..(337): Public GI ID no. 298486918
  misc_feature (1)..(337): Pseudomonas savastanoi pv. savastanoi NCPPB 3335
  misc_feature (185)..(291): Pfam Name: 2OG-FeII_Oxy Pfam Description: 2OG-Fe(II) oxygenase superfamily
  misc_feature (1)..(337): Bit score of 123.3 for HMM based on sequences of Figure 1
  misc_feature (1)..(337): Functional Homolog Of SEQ ID NO. 471
MTLHYVPIINLAPYFSGEPDGKAAVAQAVNQACKDIGFLVITEHQIPKELIDKVSGLTRQFFDLPLAEKRKVDRPSPEMVRGYSAIAEESLSYSLEESAPGDLKESFSIGPSNVPNEDYYHNAEAGSHFAPNVWPAEALLPGFKEAYQAYFEAMSELAQSLMRLFALALELDECFFDDRIDRHISMFRSLSYPDIKTEVEAGQLRASAHTDYGSLTIVRPDNALGGLQVRNQQGEWVDVPYVENGFVVNIGDLMMQWTSDQWISTLHRVVNPPISSEQDNRRQSLVFFHQPNYDTLIECLPGCLPPGTTPRHAPVTSGDHLLAKFVKQTTFGGSKVA

SEQ ID NO: 725 - protein, 385 aa, Populus tremula
  misc_feature (1)..(385): Public GI ID no. 53139624
  misc_feature (230)..(328): Pfam Name: 2OG-FeII_Oxy Pfam Description: 2OG-Fe(II) oxygenase superfamily
  misc_feature (1)..(385): Bit score of 732.7 for HMM based on sequences of Figure 1
  misc_feature (1)..(385): Functional Homolog Of SEQ ID NO. 471
MTIDCIKTMPSITAPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 726 - protein, 385 aa, Populus tomentosa
  misc_feature (1)..(385): Public GI ID no. 40233167
  misc_feature (230)..(328): Pfam Name: 2OG-FeII_Oxy Pfam Description: 2OG-Fe(II) oxygenase superfamily
  misc_feature (1)..(385): Bit score of 732.0 for HMM based on sequences of Figure 1
  misc_feature (1)..(385): Functional Homolog Of SEQ ID NO. 471
MAIDCIKTMPSITTPQHHPKDQDQCKDDGKSFVFDAQILRHQTNIPQQFVWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYTAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNGQTPRKSLAFFLCPKNDKMVTPPHELVDTCNPRIYPDFTWPMLLEFTQKHYRADMKTLEVFTNWLHQRSFT

SEQ ID NO: 727 - protein, 347 aa, Phytophthora infestans
  misc_feature (1)..(347): Public GI ID no. 301123383
  misc_feature (1)..(347): Phytophthora infestans T30-4
  misc_feature (188)..(288): Pfam Name: 2OG-FeII_Oxy Pfam Description: 2OG-Fe(II) oxygenase superfamily
  misc_feature (1)..(347): Bit score of 153.9 for HMM based on sequences of Figure 1
  misc_feature (1)..(347): Functional Homolog Of SEQ ID NO. 471
MNVHQVPVIDIGALMEFSSDVDVDAALRNPNSDSLRQIIEQIRKAASEWGFFYITNHGLPEKEVEHFQETMRSFFRLPVETKRNISRSAANARGYVEGELTKNKTDCKECFDFAGAHEDAPPNNKNDRLGEEQNQWLEEETLPGFRNEMQTYYNKMDFISRRLLKIFAVALGEEPAFFDQFFHGINSSLMRLNHYPVAPEPEKTMGVYHHTDSGALTILLQEDDVASLQVLHRESQTWVNVPPRKGTYTINIGDLVQVWSNDRFVAPLHRVLASNKAGRFSAPFFYLPAYDVEVEPIVVKQEEVPNYLPFSWRQFLLGRVQGNYADLGKENQIGDFKIHGPVDVANT

SEQ ID NO: 728 - protein, 384 aa, Solanum demissum
  misc_feature (1)..(384): Public GI ID no. 48057695
  misc_feature (231)..(328): Pfam Name: 2OG-FeII_Oxy Pfam Description: 2OG-Fe(II) oxygenase superfamily
  misc_feature (1)..(384): Bit score of 698.0 for HMM based on sequences of Figure 1
  misc_feature (1)..(384): Functional Homolog Of SEQ ID NO. 471
MAIDCMITRNNNMTSKEGQEYDIIKTNKSLSFDASLMKNESNIPSQFIWPDHEKPNCASVTRELQVPLIDLSGVLSNDPIEIKKATRLVNEACTKHGFFLVTNHGVDTNLIKKAHVYIDKFFELPLCEKQKAQRRVGEHCGYASSFIGRFSSKLPWKETLSFQYSDEKGSSHIVEQYFQRTLGEKFSHIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 729 - protein, 391 aa, Physcomitrella patens
  misc_feature (1)..(391): Public GI ID no. 168050680
  misc_feature (1)..(391): Physcomitrella patens subsp. patens
  misc_feature (232)..(326): Pfam Name: 2OG-FeII_Oxy Pfam Description: 2OG-Fe(II) oxygenase superfamily
  misc_feature (1)..(391): Bit score of 215.4 for HMM based on sequences of Figure 1
  misc_feature (1)..(391): Functional Homolog Of SEQ ID NO. 471
MPDRSLASHSDVGVQRLPKSLHGSGAALKLTGPWSLVNNCSSKGSTVSEKFVLPEHQRPTLKHDEYTDLEIPVIDVAAINNSLEGDATAKEALVAQVREACLNWGCFQIVNHDISEELLSRIQYHVNRFFNLPFAEKMKVVKQDGSVAGYGHATVKNGDVRPSSERFFFANDGSLLKDELLTVFVGACSGSYSEYYEKVHQLSGSLIRIIVQGLEVDPVHFEKYWKNTSGLLLWNFYPACPEPQKAIGINAHTDFNLLTVLHENNVGGLQIEKDGEWVAVRPRPGALAVNIGDTLQVLTNAKYRSVPHRAVVNETQTRISVAYFHVPVQGIDIVPHPELVDEHNPNKYEPFTIDTYTKIKQAQTLNTLELFLRTDTRDNGVVTIEAQSHTT

SEQ ID NO: 730 - protein, 324 aa, Streptomyces avermitilis
  misc_feature (1)..(324): Public GI ID no. 29831348
  misc_feature (1)..(324): Streptomyces avermitilis MA-4680
  misc_feature (182)..(284): Pfam Name: 2OG-FeII_Oxy Pfam Description: 2OG-Fe(II) oxygenase superfamily
  misc_feature (1)..(324): Bit score of 104.5 for HMM based on sequences of Figure 1
  misc_feature (1)..(324): Functional Homolog Of SEQ ID NO. 471
MSDARTPRIPTVDLRPWLSGDPDARARIARTVDDALRTAGFLLVTGHGVDPSLRTRIRVAARAFFTLPAETKQRYAARVGGRGWLGPGAEANGYSEGTETPPDLKESLTFATHEPFEDPETNAEWYAPNVWPAEAPELREPCEEYLAEMAGLEDRLLTLLGEALGLEPDFFTKHMTHPTYGFNINWYPGTEVTGDPAPGQFRIGPHTDFGTVTILDRQAGKGGLQVYTDDGGWADAPFDPAAFTINIGDLMARWTGDRWRSGRHRVLPPPADAPAEELMSLVYFGECTPGTLVESVPAPVGRVAYEPVDSHTYLREKLNSITVD

SEQ ID NO: 731 - protein, 367 aa, Oryza sativa
  misc_feature (1)..(367): Public GI ID no. 115470777
  misc_feature (1)..(367): Oryza sativa Indica Group
  misc_feature (202)..(304): Pfam Name: 2OG-FeII_Oxy Pfam Description: 2OG-Fe(II) oxygenase superfamily
  misc_feature (1)..(367): Bit score of 524.2 for HMM based on sequences of Figure 1
  misc_feature (1)..(367): Functional Homolog Of SEQ ID NO. 471
MAAVVFDAAILSKQEAIPAQFVWPADEAPAADDGVVEEIAIPVVDLAAFLASGGIGRDVAEACERHGFFQVVNHGVDPALLAEAYRCCDAFYARPLAEKQRARRRPGENHGYASSFTGRFDCKLPWKETMSFNCSAAPGNARMVADYFVDALGEEYRHMGEVYQEYCDVMTRLALDVTEVLAVALGLGRGELRGFFADGDPVMRLNHYPPCRQPHLTLGTGPHRDPTSLTLLHQDDVGGLQVLPDDAAAAAGGWRAVRPRADAFVVNIGDTFAALTNGRHASCLHRAVVNGRVARRSLTFFLNPRLDRVVSPPPALVDAAHPRAFPDFTWREFLEFTQRHYRSDTNTMDAFVAWIKQRNGYESLDKY

SEQ ID NO: 732 - protein, 392 aa, Glycine max
  misc_feature (1)..(392): Public GI ID no. 255642379
  misc_feature (232)..(329): Pfam Name: 2OG-FeII_Oxy Pfam Description: 2OG-Fe(II) oxygenase superfamily
  misc_feature (1)..(392): Bit score of 511.3 for HMM based on sequences of Figure 1
  misc_feature (1)..(392): Functional Homolog Of SEQ ID NO. 471
MSPPLMESSASTLVIYPASQPQQEPKNENNGGIVFGSNLQQMQGEMPKEFLWPSRDLVDTTQEELKEPLVDLAIFKNGDEKAIANAAELVRTACLKHGFFQVINHGVDPDLIDAAYHEIDSIFKLPLSKKMGAKRKPGGVSGYSGAHADRYSSKLPWKETFSFLYDHQSFSNSQIVDNFKSVLGEDLQHTGRVYQKYCEAMKDLSLVIMELLAISLGVDRGHYRRFFEDGDSIMRCNYYPPCNSANLTLGTGPHTDPTSLTTLHQDQVGGLEVFVDNKWFAVRPRSEALVINIGDTFMALSNGRYKSCLHRALVDTYRERRSLVYFVCPGEDKIVRPPDNLLCRNEERKYPDFTWSNLFEFTQKHYRADVATLQSFIEWQQCSNSMSKPSNF

SEQ ID NO: 733 - protein, 397 aa, Selaginella moellendorffii
  misc_feature (1)..(397): Public GI ID no. 302797547
  misc_feature (249)..(346): Pfam Name: 2OG-FeII_Oxy Pfam Description: 2OG-Fe(II) oxygenase superfamily
  misc_feature (1)..(397): Bit score of 262.2 for HMM based on sequences of Figure 1
  misc_feature (1)..(397): Functional Homolog Of SEQ ID NO. 471
MAVQSRPAGFPSFASPPKRDRHTKERIPRSLLQLQSSTATTSESAAALERQNICKLSALLKDTNLLPERYVIPESHRARLSHDAFLPEVELPMIDFETLKSGAGTEILAREVGNACRDWGFFQIVNHGVPGDLIQEMLLHADQFFHLPYRQKEKAAIFPRPLGYNGRYTDLSSSAPWVEAMAMQQTPYSTVDKTVDRVWPGEGNPRLRRALRRYHAEMEKLGQSVVQLIALSLGLERRTFSRHFEESSSTFRWNHYPPCPLPSKALGLLAHSDPSAITILHQDSVGGLQIRKDGRWIAVKPRPDTFVINLGDVFQAWTNGRYKSVEHRAVVNQKQGRLSMVFFYGPQEDYVITPPDELIDEDHPLRYRPFTWGDYSAARLSIPAHGKRHLDVFAGAL

SEQ ID NO: 734 - protein, 385 aa, Populus tremula
  misc_feature (1)..(385): Public GI ID no. 53139648
  misc_feature (230)..(328): Pfam Name: 2OG-FeII_Oxy Pfam Description: 2OG-Fe(II) oxygenase superfamily
  misc_feature (1)..(385): Bit score of 733.9 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 735 - protein, 350 aa, Novosphingobium nitrogenifigens
  misc_feature (1)..(350): Public GI ID no. 326385638
  misc_feature (1)..(350): Novosphingobium nitrogenifigens DSM 19370
  misc_feature (188)..(294): Pfam Name: 2OG-FeII_Oxy Pfam Description: 2OG-Fe(II) oxygenase superfamily
  misc_feature (1)..(350): Bit score of 123.3 for HMM based on sequences of Figure 1
  misc_feature (1)..(350): Functional Homolog Of SEQ ID NO. 471
MGFIMMLTDVPTIDLTPYRLGTEEGKRAVAEAVGKACTDIGFLVISGHGVPQDLIERTYAVSRRFFALPASEKALLNRPQSDQVRGYSAVGDEGLSYSLGEVAPPDLKESLSIGPLNVPADDPYYHNAEAGPHFAPNLWPESLPELKTVWSEYFAEMERLSCDLMRIFALALDLPENWFDPTGDRHISMFRALHYPNQPDAPLDGQMRAGAHSDYGALTILRQENVPGSLQVCNREGNWVDVPAIPGTFVVNIGDLMMQWTNDKWISTLHRVVNPPRDLADQASRVSLVYFYQPNYDAVVSCLDSCQSPDQPARYPPITSGDHLTAKFVQQTTLGGTKDGAETILGETAA

SEQ ID NO: 736 - protein, 381 aa, Paeonia suffruticosa
  misc_feature (1)..(381): Public GI ID no. 147916856
  misc_feature (225)..(322): Pfam Name: 2OG-FeII_Oxy Pfam Description: 2OG-Fe(II) oxygenase superfamily
  misc_feature (1)..(381): Bit score of 538.9 for HMM based on sequences of Figure 1
  misc_feature (1)..(381): Functional Homolog Of SEQ ID NO. 471
MSLLLDSSTNTHLTCPPMELKGDRENGVLLFDSLQKQANLPTEFVWPQGDLVRTQEEELKEPLVDLAGFYTGDELATTHAAELIRTACLNHGFFQVINHGIDANLISAAHDEMNVFFKLPISKKLSVRRKPGGVWGYSGAHSDRYTSKLPWKETLSFGYQGSASHPVVVDYFKSSLGKDFEHTGWVYQSYCEAMKELSLVIMELLAISLGVDRLYYRKYFKDGSSIMRCNYYPPCNEPGLTLGTGPHCDPTSITILHQDQVGGLEVFANNKWQGVRPRPDAFVINIGDTFMALSNGKYKSCLHRAVVNRESERRSLVFFVCPKEDKVVRPPQDLVGREVPRKYPDFTWSDLFEFTQKHYRADVTTLQSFFQWLLSSKPSKF

SEQ ID NO: 737 - protein, 386 aa, Cucurbita maxima
  misc_feature (1)..(386): Public GI ID no. 486625
  misc_feature (220)..(318): Pfam Name: 2OG-FeII_Oxy Pfam Description: 2OG-Fe(II) oxygenase superfamily
  misc_feature (1)..(386): Bit score of 499.2 for HMM based on sequences of Figure 1
  misc_feature (1)..(386): Functional Homolog Of SEQ ID NO. 471
MALNGKVATESAPSNLNEEMKGEYRPPFGGSDESKVPEDFIWSEKFEASELLPVLDVPTIDLEKFMSGDKSYVEEATRLVDEACRQHGIFFVVNHGVDIEMMGRVHDCMNEFFTMPLDVKQRAKRKVGESYGYTNSFFGRFASNLPWKETFSLRCVAAQNSSAAHDYVLDTLGPSFSHHGKAYQECGIALNELGTKIVELLGLSLGISREYFKNFFEDNDSILRLNYYPTCDKPEVVLGTGPHTDPTSVTILHQDPVSGLQVCSNDQWYSIPPNPEAFVINIGDTFTSLTNGIYKGCIHRAVVNSMNARKSLAFFLCPSHDKVVRAPEELVEKSPPRKYPDYKWPMLLEMTQKRYRPDCNTLEAFKTWVQEGKALDTGSTITAPSA

SEQ ID NO: 738 - protein, 431 aa, Brassica rapa
  misc_feature (1)..(431): Public GI ID no. 197090668
  misc_feature (1)..(431): Brassica rapa subsp. pekinensis
  misc_feature (292)..(377): Pfam Name: 2OG-FeII_Oxy Pfam Description: 2OG-Fe(II) oxygenase superfamily
  misc_feature (1)..(431): Bit score of 90.0 for HMM based on sequences of Figure 1
  misc_feature (1)..(431): Functional Homolog Of SEQ ID NO. 471
MGADTPQLPVIYLSDQTLKPGSEKWVEVRSDVRKALEDYGGFEVSYDRVSEELKKSVLDAMIELFELPVEAKQRNVSPKPYTGYSTHNGLSESLGIQNSNVLEKVNEFTQLLRPDCEGNKSMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDVCTGAGTNHNGDDVNTGDCANVKSNVDVGTNVSAKSSVGADVNANAGTRSSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRARSTLHAYCAVSGA

SEQ ID NO: 739 - protein, 378 aa, Solanum lycopersicum
  misc_feature (1)..(378): Public GI ID no. 154705630
  misc_feature (219)..(317): Pfam Name: 2OG-FeII_Oxy Pfam Description: 2OG-Fe(II) oxygenase superfamily
  misc_feature (1)..(378): Bit score of 731.9 for HMM based on sequences of Figure 1
  misc_feature (1)..(378): Functional Homolog Of SEQ ID NO. 471
MAIDCMIPNGRSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 740 - protein, 382 aa, Physcomitrella patens
  misc_feature (1)..(382): Public GI ID no. 168032021
  misc_feature (1)..(382): Physcomitrella patens subsp. patens
  misc_feature (233)..(329): Pfam Name: 2OG-FeII_Oxy Pfam Description: 2OG-Fe(II) oxygenase superfamily
  misc_feature (1)..(382): Bit score of 255.7 for HMM based on sequences of Figure 1
  misc_feature (1)..(382): Functional Homolog Of SEQ ID NO. 471
MAAHPVPSHAHNAADLSAVLTNTNTTLRNASLLSALVHKTQQLPPIFVEAEGQRPVLEMGSPPLASTHVIPIVDMSLLSSSDPAVRASLVEEIVAACEKYGFFQVVNHGVSENLILRCETEAHKMFELPLEVKERVHRPPGTSFGYGANTWVNQTVMHWAESFHMQLHPKSNIREFSRKLFTESDYTIFSSTVEKYMGQIEKLGRHLVELLTEGLGLEPTRFNHYVENECMMSMRFNLYPPCPQPELAIGLRAHTDPHLLTILHQDEIAGLQVQIDEEWITVNPRPDCFVVNIGDLFQVLSNTRYKSVLHRAVVNGTSKRLSLACFLNPPLNATVEPPPELITTERPPVYRPFTWGEYLANAYNFHPANGGERHERFFLEKS

SEQ ID NO: 741 - protein, 385 aa, Gossypium hirsutum
  misc_feature (1)..(385): Public GI ID no. 58700543
  misc_feature (225)..(323): Pfam Name: 2OG-FeII_Oxy Pfam Description: 2OG-Fe(II) oxygenase superfamily
  misc_feature (1)..(385): Bit score of 604.8 for HMM based on sequences of Figure 1
  misc_feature (1)..(385): Functional Homolog Of SEQ ID NO. 471
MVHCLPKVSVIQDKPMLPPTAAVAKNKHRPLAFDASILGSEISSQFIWPDDDKPCLDAPELVIPTIDLGAFLLGDSLAVSKAAEAVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFDENDSILRLNHYPPCQKPELTLGTGPHTDPTSLTILHQDQVGGLQVFADEKWHSVAPIPRAFVVNIGDTFMALTNGIYKSCLHRAVVNTETVRKSLVFFLCPKLERPVTPAAGLVNAANSRKYPDFTWAALLEFTQNHYRADMKTLVAFSKWVQEQESNNKLIP

SEQ ID NO: 742 - protein, 182 aa, Helleborus orientalis
  misc_feature (1)..(182): Public GI ID no. 317454944
  misc_feature (35)..(133): Pfam Name: 2OG-FeII_Oxy Pfam Description: 2OG-Fe(II) oxygenase superfamily
  misc_feature (1)..(182): Bit score of 102.0 for HMM based on sequences of Figure 1
  misc_feature (1)..(182): Functional Homolog Of SEQ ID NO. 471
MTSKMHELELIILKMIMESYGLGKYYDSYVESNNSVCRLMRYTPPKNNEAEIALWAHVDMNVISMLCQNSVQGLEIKFKEDQWTKVAALPGQFIVFVGDSLRVWSNGRIRSTEHRVTIKGDKMRYTTALFITPKEGVIVEAPEELIDEEHPRLFRPFTYVEYLEHIKIRGYVDNALVLFAGI

SEQ ID NO: 743 - protein, 440 aa, Brassica juncea
  misc_feature (1)..(440): Public GI ID no. 198286476
  misc_feature (301)..(386): Pfam Name: 2OG-FeII_Oxy Pfam Description: 2OG-Fe(II) oxygenase superfamily
  misc_feature (1)..(440): Bit score of 90.0 for HMM based on sequences of Figure 1
  misc_feature (1)..(440): Functional Homolog Of SEQ ID NO. 471
MGSDSTPQLPVIHLSDQTLKPGSEKWVEVRSDVRKALEDYGGFEVSYDRVSEELKKSVLDAMIELFELPVEAKQRNVSPKPYTGYSTHNGLSESLGIQDSNVLEKVNEFTQLLRPDCEGNKTMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDVCTGAGTNHNGDDVNTGDCANVKSNVDVGTNVSAKSSVGADVNTGTIDDVNANAGTRSSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRARSTLHAYCAVSGA

SEQ ID NO: 744 - protein, 335 aa, Hylemonella gracilis
  misc_feature (1)..(335): Public GI ID no. 332531325
  misc_feature (1)..(335): Hylemonella gracilis ATCC 19624
  misc_feature (183)..(288): Pfam Name: 2OG-FeII_Oxy Pfam Description: 2OG-Fe(II) oxygenase superfamily
  misc_feature (1)..(335): Bit score of 130.1 for HMM based on sequences of Figure 1
  misc_feature (1)..(335): Functional Homolog Of SEQ ID NO. 471
MSVLNVPVIDLEPWFAGTPEGKAAVARAVDEACRGIGFLVITHHQIDPALIRRVSEASRRFFALPLAEKRKVDRPRDDAVRGYSAVGEEGLSYSLEEAAPGDLKESFSIGPSHVPDDDYHRGPAAGAHFEPNQFPAGIDDFQEAYEAYFAAASHLASELMRMFAVGLGLRETFFDDKINEHISMFRVLSYPAQTEPPLPGQMRAGAHSDYGSLTIVLPDGPGLQVFNKAGQWVDVPHIPDAFAVNIGDLMMQWTNDQWTSTLHRVVNPPFDDAMKNTRRQSLVFFHQPNYDAMIECLPVCLAPGEAPKYAPVSSGEHLTSKFVKQTTFGGTKVSA

SEQ ID NO: 745 - protein, 349 aa, Selaginella moellendorffii
  misc_feature (1)..(349): Public GI ID no. 302821145
  misc_feature (187)..(284): Pfam Name: 2OG-FeII_Oxy Pfam Description: 2OG-Fe(II) oxygenase superfamily
  misc_feature (1)..(349): Bit score of 339.2 for HMM based on sequences of Figure 1
  misc_feature (1)..(349): Functional Homolog Of SEQ ID NO. 471
MNTSCELESYVWPRGDCSLPEHGKFASQQDVPTIDLAGGSKAKVDEIGRACRQSGFFQVVNHGVDHELVNQVHASARQFFEFPSDTKLRAARSAGNSFGFAGKFAGRFKSKCPWKETFSLQYTPNSNIKDYMIKVYTAEQHEQHCALYETYCKAMEKLGRELIELIAQSLELAPDALHSYFDDGFSIFRMNMYPPSEHFSRLLGTGPHTDPCALTILHQDEVGGLQVYNRDETWVTVEPRADAFVISIGDTFQALCNHRYKSAKHRAVIHATRARHSLVFFINPGLDTVIRPIPELVVKSKEDEEQDRERPCVEFNWGQLLEFTQKHYRTDVHTLDAFESYLRKTSQAA

SEQ ID NO: 746 - protein, 359 aa, Dasypyrum villosum
  misc_feature (1)..(359): Public GI ID no. 255927085
  misc_feature (201)..(299): Pfam Name: 2OG-FeII_Oxy Pfam Description: 2OG-Fe(II) oxygenase superfamily
  misc_feature (1)..(359): Bit score of 693.9 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRRSLAFFLCPEMDKVVAPPGTLVDAANPRAYPDFTWRSLLDFTQKHYRADMKTLEVFSSWVVQQQQAAMT

SEQ ID NO: 747 - protein, 295 aa, Arabidopsis thaliana
  misc_feature (1)..(295): Public GI ID no. 8778664
  misc_feature (139)..(234): Pfam Name: 2OG-FeII_Oxy Pfam Description: 2OG-Fe(II) oxygenase superfamily
  misc_feature (1)..(295): Bit score of 373.3 for HMM based on sequences of Figure 1
  misc_feature (1)..(295): Functional Homolog Of SEQ ID NO. 471
MAHGTFLVVNHGFKSGLAEKALEISSLFFGLSKDEKLRAYRIPGNISGYTAGHSQRFSSNLPWNETLTLAFKKGPPHVVEDFLTSRLGNHRQEIGQVFQEFCDAMNGLVMDLMELLGISMGLKDRTYYRRFFEDGSGIFRCNYYPPCKQPEKALGVGPHNDPTAITVLLQDDVVGLEVFAAGSWQTVRPRPGALVVNVGDTFMALSNGNYRSCYHRAVVNKEKVRRSLVFFSCPREDKIIVPPPELVEGEEASRKYPDFTWAQLQKFTQSGYRVDNTTLHNFSSWLVSNSDKKST

SEQ ID NO: 748 - protein, 356 aa, Rhodococcus erythropolis
  misc_feature (1)..(356): Public GI ID no. 229490954
  misc_feature (1)..(356): Rhodococcus erythropolis SK121
  misc_feature (194)..(298): Pfam Name: 2OG-FeII_Oxy Pfam Description: 2OG-Fe(II) oxygenase superfamily
  misc_feature (1)..(356): Bit score of 98.2 for HMM based on sequences of Figure 1
  misc_feature (1)..(356): Functional Homolog Of SEQ ID NO. 471
MTHETPVFEIPTIDISPYLRGEAAVANATNSTACAEVAAQLDRACREVGFIQIVGHSIPRSATKGLADALDEFFALPLTVKNNYRRPSSENRGYSPPKSESLSMSLGVAAANQMNDFYEAIVVGTEVSDYPGVDLPESSYAANTWPVAAPGFRPAIEEYFRHAQGLARILMCAFTDALGLQPGYFDSMLDHSIDAMKMNNYALPEGEIRISGDMTGMGAHTDFGILTILWADRVPGLQVLSADGVWHDVQPADGALLINLGDAMARWTNDRWRSTVHRVDPPIVDGQIIRRRSAAFFFDGNYDAVIEALPGTLTPGEVGYPPITIAENIAAKVAGLKGATAPDVDSRSADRLRAAG

SEQ ID NO: 749 - protein, 359 aa, Dasypyrum villosum
  misc_feature (1)..(359): Public GI ID no. 255927099
  misc_feature (201)..(299): Pfam Name: 2OG-FeII_Oxy Pfam Description: 2OG-Fe(II) oxygenase superfamily
  misc_feature (1)..(359): Bit score of 690.4 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALPRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 750 - protein, 385 aa, Populus alba
  misc_feature (1)..(385): Public GI ID no. 34013370
  misc_feature (230)..(328): Pfam Name: 2OG-FeII_Oxy Pfam Description: 2OG-Fe(II) oxygenase superfamily
  misc_feature (1)..(385): Bit score of 735.1 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 751 - protein, 382 aa, Vitis vinifera
  misc_feature (1)..(382): Public GI ID no. 225455655
  misc_feature (225)..(323): Pfam Name: 2OG-FeII_Oxy Pfam Description: 2OG-Fe(II) oxygenase superfamily
  misc_feature (1)..(382): Bit score of 727.3 for HMM based on sequences of Figure 1
  misc_feature (1)..(382): Functional Homolog Of SEQ ID NO. 471
MSIVCVEGNPPSMFNPPTDDHKNQEPLVFDASVLRHQSNIPKQFIWPDAEKPGDKATELSVPLIDLGGFLSGDPAAAMEATRLVREACQKHGFFLVVNHGVDDKLIYKAHQYMDSFFGLPLAKKQRAQRKLGEHCGYASSFIGRFSSKLPWKETLSFSYSAEKKSSNAVQEYFLNKMGEDFSEFGQVYQDYCEAMSTLSLVIMELLGMSLGIGGAHFREFFEENDSIMRLNYYPPCLKPDLTLGTGPHCDPTSLTILHQDQVGGLQVFVDDKWWSISPNFDAFVVNIGDTFMALSNGRYKSCLHRAVVNSQTPRKSLAFFLCPEKDKVVRPPTELVDTNSPRIYPDFTWSNLLEFTQKHYRADMKTLEVFSSWLQQKTAEAV

SEQ ID NO: 752 - protein, 376 aa, Physcomitrella patens
  misc_feature (1)..(376): Public GI ID no. 168046914
  misc_feature (1)..(376): Physcomitrella patens subsp. patens
  misc_feature (228)..(324): Pfam Name: 2OG-FeII_Oxy Pfam Description: 2OG-Fe(II) oxygenase superfamily
  misc_feature (1)..(376): Bit score of 265.3 for HMM based on sequences of Figure 1
  misc_feature (1)..(376): Functional Homolog Of SEQ ID NO. 471
MATNQPPNPFSLIRAASITPAAQSSLQSLLSQSSQDLADFVWPEEERPTIPHNDYRRDRELPVIDLSGLQGGSEATKLRLAKRIAAACSEWGFFQLINHGIPVAELDEVQMQTRRFFELPMEHKQRAMTLETANASNVYGYGLNTTGYKYAGRPWIERFQCSWSPKSNLREQAQRLLEGQAFQDFQTAVESFCSGAEKLAKLTLELCALGLGLSPDTFSKHMNPSHSIARLNYYPACPTPDLTLGLGAHTDPYTLTLLHQCQVGGLQVCKDGKWITVKPRRGAYVVNVGDNLQAWTNGRFKSVEHRAVLNDKVPRLSLVFFYAPPLETVITAPDAIIQADGKRRYKSFTWAEYLNFLKRQNFEKGKNERWVEGFAL

SEQ ID NO: 753 - DNA, 1267 bp, Arabidopsis thaliana
  misc_feature (1)..(1267): Ceres Clone ID no. 156575
  misc_feature (1)..(1267): Encodes the peptide sequence at SEQ ID NO. 754
aatactactactcactttactataatctctcaaaatggccgtaagtttcgtaacaacatctcctgaggaagaagacaaaccgaagctaggccttggaaatattcaaactccgttaatcttcaacccttcaatgcttaaccttcaagccaatatcccaaaccaattcatctggcctgacgacgaaaaaccttccatcaacgttctcgagcttgatgttcctctcatcgaccttcaaaaccttctctctgatccatcctccactttagatgcttcgagactgatctctgaggcctgtaagaagcacggtttcttcctcgtggtcaatcacggcatcagcgaggagcttatatcagacgctcatgaatacacgagccgcttctttgatatgcctctctccgaaaaacagagggttcttagaaaatccggtgagagtgttggctacgcaagcagtttcaccggacgcttctccaccaagcttccatggaaggagaccctttctttccggttttgcgacgacatgagccgctcaaaatccgttcaagattacttctgcgatgcgttgggacatgggtttcagccatttgggaaggtgtatcaagagtattgtgaagcaatgagttctctatcactgaagatcatggagcttctcgggctaagtttaggcgtaaaacgggactactttagagagtttttcgaagaaaacgattcaataataagactgaattactaccctccatgtataaaaccagatctcacactaggaacaggacctcattgtgatccaacatctcttaccatccttcaccaagaccatgttaatggccttcaagtctttgtggaaaatcaatggcgctccattcgtcccaaccccaaggcctttgtggtcaatatcggcgatactttcatggctctatcgaacgatagatacaagagctgcttgcaccgggcggtggtgaacagcgagagcgagaggaagtcacttgcattcttcttgtgtccgaaaaaagacagagtagtgacgccaccgagagagcttttggacagcatcacatcaagaagataccctgacttcacatggtctatgttccttgagttcactcagaaacattatagagcagacatgaacactctccaagccttttcagattggctcaccaaacccatctaagaaataaaatattcatgtcttgtcttgttagttataactagtatcttctttatatttcatgtatgtatatggtaataggcaataacaccttttagcatc

SEQ ID NO: 754 - protein, 377 aa, Arabidopsis thaliana
  misc_feature (1)..(377): Ceres Clone ID no. 156575
  misc_feature (224)..(322): Pfam Name: 2OG-FeII_Oxy Pfam Description: 2OG-Fe(II) oxygenase superfamily
  misc_feature (1)..(377): Bit score of 674.0 for HMM based on sequences of Figure 1
  misc_feature (1)..(377): Functional Homolog Of SEQ ID NO. 471
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIIRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 755 - DNA, 1568 bp, Panicum virgatum
  misc_feature (1)..(1568): Ceres Clone ID no. 1962928
  misc_feature (1)..(1568): Encodes the peptide sequence at SEQ ID NO. 756
gcacactcgcacctcgcacatctcatggtgtcccaagcacagcaagagccagctctgcctcacagcagcagcagcagcagcatcgccaagcttgcagccgccgcgtccatggacactactagcccggccccgcctctcctcctccgcgccccgactcccagcattgacctccccgcgaccaagcaggacagggccgacgcggccagcaaggcgttcgacctgcgccgggagcccaagatcccggcgccgttcgtgtggccgcacgacgacgcgcgcccgacgtcggccgcggggctggacgtgccggtggtggacgtgggcgtgctgcgcaatggcgaccgcgcggggctgcgccgcgccgcggcgcaggtggccgcggcgtgcgcgacgcacggcttcttccaggtgtgcgggcacggcgtggacgcgggcctggcgcgcgccgcgctggacggcgccagcgacttcttccggctgccgctggccgagaagcagcgcgcccggcgcgtcccgggcaccgtgtccgggtacacgagcgcgcacgccgaccggttcgcgtccaagctcccctggaaggagaccctctccttcggcttccacgacggcgccgcgtcgcccgtcgtcgtcgactacttcgccggcaccctcggccaggatttcgagccaatggggcgcgtgtaccagaggtactgcgaggagatgaaggctctgtcgctgacgatcatggagctgctggaggtgagcctgggcgtggagcgcggctgctaccgggacttcttcgaggacagccgctccatcatgcggtgcaactactacccgccgtgcccggagccggagcgcacgctgggcacgggcccgcactgcgaccccaccgcgctgaccatcctgctccaggacgacgtcggcgggctggaggtcctcgtcgacggcgagtggcgccccgtcctccccgtgcccggcgccatggtcatcaacatcggcgacaccttcatggcgctgtccaacgggcggtacaagagctgcctccaccgcgcggtggtgaaccggcagcaggagcggcggtcgctggccttcttcctgtgcccgcgcgaggaccgggtggtgcgcccgccggccagcggcgccgtcgccgcggcgccgcgccgctacccggacttcacctgggccgacctcatgcgcttcacgcagcagcactaccgcgccgacacccgcacgctggacgccttcacaagctggctcgccctcggcccggcccacgacgcggcgcccgctccctgcagcacctaacgtctctttcgccgggcggggcccggggggttcagcccacgtgcgcgcccaggtggggcgggccgtgggcagtggcggccgtggatcttatatatcttccggacccccggtggcggcctcgtggccagcgggccccgtgccggctttctcatttttggaagctgccgcgcgctgcgcgtgccgggcgcgtgcgccgacggcctactgctatttgctactagtgtacatatacaaacatactcctatattatacatatatataagcaaccgctttttctttc

SEQ ID NO: 756 - protein, 420 aa, Panicum virgatum
  misc_feature (1)..(420): Ceres Clone ID no. 1962928
  misc_feature (257)..(354): Pfam Name: 2OG-FeII_Oxy Pfam Description: 2OG-Fe(II) oxygenase superfamily
  misc_feature (1)..(420): Bit score of 500.0 for HMM based on sequences of Figure 1
  misc_feature (1)..(420): Functional Homolog Of SEQ ID NO. 471
MVSQAQQEPALPHSSSSSSIAKLAAAASMDTTSPAPPLLLRAPTPSIDLPATKQDRADAASKAFDLRREPKIPAPFVWPHDDARPTSAAGLDVPVVDVGVLRNGDRAGLRRAAAQVAAACATHGFFQVCGHGVDAGLARAALDGASDFFRLPLAEKQRARRVPGTVSGYTSAHADRFASKLPWKETLSFGFHDGAASPVVVDYFAGTLGQDFEPMGRVYQRYCEEMKALSLTIMELLEVSLGVERGCYRDFFEDSRSIMRCNYYPPCPEPERTLGTGPHCDPTALTILLQDDVGGLEVLVDGEWRPVLPVPGAMVINIGDTFMALSNGRYKSCLHRAVVNRQQERRSLAFFLCPREDRVVRPPASGAVAAAPRRYPDFTWADLMRFTQQHYRADTRTLDAFTSWLALGPAHDAAPAPCST

SEQ ID NO: 757 - protein, 389 aa, Oryza barthii
  misc_feature (1)..(389): Public GI ID no. 37359180
  misc_feature (227)..(324): Pfam Name: 2OG-FeII_Oxy Pfam Description: 2OG-Fe(II) oxygenase superfamily
  misc_feature (1)..(389): Bit score of 493.4 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 758 - protein, 371 aa, Oryza sativa
  misc_feature (210)..(308): Pfam Name: 2OG-FeII_Oxy Pfam Description: 2OG-Fe(II) oxygenase superfamily
  misc_feature (1)..(371): Bit score of 643.7 for HMM based on sequences of Figure 1
  misc_feature (1)..(371): Functional Homolog Of SEQ ID NO. 471
MSMVVQQEQEVVFDAAVLSGQTEIPSQFIWPAEESPGSVAVEELEVALIDVGAGAERSSVVRQVGECERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 759 - protein, 298 aa, Ostreococcus tauri
  misc_feature (1)..(298): Public GI ID no. 308810887
  misc_feature (162)..(263): Pfam Name: 2OG-FeII_Oxy Pfam Description: 2OG-Fe(II) oxygenase superfamily
  misc_feature (1)..(298): Bit score of 94.0 for HMM based on sequences of Figure 1
  misc_feature (1)..(298): Functional Homolog Of SEQ ID NO. 471
MSTVDVPILNLESPSGEQIKIIEAAAAQFGFFRVDIASVSNVFGVDVERAVADAFRVSRTFFGRDASRKDELRARPGCGYTAFGSETLDARGSSTGDAKEGFYVARTGTPWPADDDEFRDVSERYYAMMFRLGRVLLGLFASVLGCDRAFFDEHWDGEHSCVLRYLRYPRGAASDEKSGAFACGAHSDYGAITILATDETPGLQIYDRESRRWKGVAPRTDTFIVNVGDLLERWSNKKLVSTRHRVMTSGERERYSIPFFFEPRKDSVITPVCDDGEEPMFAPKQFGEYLQERYTETY

SEQ ID NO: 760 - protein, 296 aa, Vitis vinifera
  misc_feature (1)..(296): Public GI ID no. 296084082
  misc_feature (168)..(266): Pfam Name: 2OG-FeII_Oxy Pfam Description: 2OG-Fe(II) oxygenase superfamily
  misc_feature (1)..(296): Bit score of 361.5 for HMM based on sequences of Figure 1
  misc_feature (1)..(296): Functional Homolog Of SEQ ID NO. 471
MSIVCVEGNPPSMFNPPTDDHKNQEPLVFDASVLRHQSNIPKQFIWPDAEKPGDKATELSVPLIDLGGFLSGDPAAAMEATRLVREACQKHGFFLVTLSFSYSAEKKSSNAVQEYFLNKMGEDFSEFGQVYQDYCEAMSTLSLVIMELLGMSLGIGGAHFREFFEENDSIMRLNYYPPCLKPDLTLGTGPHCDPTSLTILHQDQVGGLQVFVDDKWWSISPNFDAFVVNIGDTFMALSNGRYKSCLHRAVVNSQTPRKSLAFFLCPEKDKVKHYRADMKTLEVFSSWLQQKTAEAV

SEQ ID NO: 761 - protein, 380 aa, Musa balbisiana
  misc_feature (1)..(380): Public GI ID no. 102139962
  misc_feature (220)..(317): Pfam Name: 2OG-FeII_Oxy Pfam Description: 2OG-Fe(II) oxygenase superfamily
  misc_feature (1)..(380): Bit score of 506.0 for HMM based on sequences of Figure 1
  misc_feature (1)..(380): Functional Homolog Of SEQ ID NO. 471
MDSVSPVTLDLNKEEGHCSNSAVVFDTSFLRRQAKIPESFVWPRSERPHPLEELEVPVVDLRGLFEGDEASISRAAEASRAACVRHGFFQVINHKVDAKVSGDALDAAGDFFKLPLSTKLRARRQPGSAWGYVGAHADRFASKLPWKETLTFGYDYGERGDGVVDYFTSKLGEGFEPMGRVYRRYCEAMKELSLSIMELLGISLGVGREYYRQFFEDGSSIMRCNSYPPCQEPELALGTGPHCDPTALTILLQDQVGGLQVFTEGKWQAVRPVRSAVVINIGDTFMALSNGRYKSCLHRAVVNSERERLSLAFFVCPRGDRVVRPPRELLLLLEEEEEAVPRAFPDFTWTELLEFTQTHYRADTTTLQSFSRHRFLASSP

SEQ ID NO: 762 - protein, 332 aa, Gibberella zeae
  misc_feature (1)..(332): Public GI ID no. 46127407
  misc_feature (1)..(332): Gibberella zeae PH-1
  misc_feature (180)..(279): Pfam Name: 2OG-FeII_Oxy Pfam Description: 2OG-Fe(II) oxygenase superfamily
  misc_feature (1)..(332): Bit score of 55.8 for HMM based on sequences of Figure 1
  misc_feature (1)..(332): Functional Homolog Of SEQ ID NO. 471
MTASSRPAEYRDVRTANLNTITFDNLFDKDEAELKRLIESCEKDGFFYLDLKSAASQKFWNDLYTIDSTTKDWFKQPIEKKLQTPTVSLAHGFKAVGNQSGSIESKKDGFEALKIGKSELDGRWALPDVVSDNLPLFDQFASSCHFISKLLLDCLSDGLNLKGDARFETHHRDDCRSKSTLYFLHYPPGAQDPNKVGQNMHTDIGTLTILYAPQWGLQVFSPADGAWEYVEPRPNQIIVNVGDTLRFLSGKRFKSALHRVLPLGGIQIEDRYSISYFLRASDSTEFKDSDEDESNAKQWYTKKYAMYEMPHVIQKQQTTLSGGMAQELQATF

SEQ ID NO: 763 - protein, 359 aa, Dasypyrum villosum
  misc_feature (1)..(359): Public GI ID no. 255927107
  misc_feature (201)..(299): Pfam Name: 2OG-FeII_Oxy Pfam Description: 2OG-Fe(II) oxygenase superfamily
  misc_feature (1)..(359): Bit score of 690.9 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCPEMDKVVAPPGTLVDAANPRAYPGFTWRSLLDFTQKHYRADMKTLEVFSSWVVQQQQAAMT

SEQ ID NO: 764 - protein, 363 aa, Lolium perenne
  misc_feature (1)..(363): Public GI ID no. 13625521
  misc_feature (202)..(299): Pfam Name: 2OG-FeII_Oxy Pfam Description: 2OG-Fe(II) oxygenase superfamily
  misc_feature (1)..(363): Bit score of 695.3 for HMM based on sequences of Figure 1
  misc_feature (1)..(363): Functional Homolog Of SEQ ID NO. 471
MVQPVFDAALLSGQSDIPSQFIWPADESPSPDATEELHVPLIDIGGLLSGDRVAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 765 - protein, 379 aa, Populus trichocarpa
  misc_feature (1)..(379): Public GI ID no. 224083474
  misc_feature (226)..(323): Pfam Name: 2OG-FeII_Oxy Pfam Description: 2OG-Fe(II) oxygenase superfamily
  misc_feature (1)..(379): Bit score of 531.0 for HMM based on sequences of Figure 1
  misc_feature (1)..(379): Functional Homolog Of SEQ ID NO. 471
MSLLMDSTSSSLLLSPPPFHSKDETDAPVLYSSFLQKQANMPTEFIWPIGDLVHNQDELKEPLIDLDGFLKGDERATADAAELVRTACLNHGFFQVINHGVDIGLIHAAHEEIDKIFKLPLDKKLSTRRKPGDVSGYSGAHAHRYSSKLPWKETFSFGYHGDDDSEPLVVDYFKSVLGENFEHTGWVYQRYCEAMKKVSLVIFELLGISLGVDRLHYRKFFEDGSSIMRCNNYPPCNNSSLTLGTGPHCDPTSLTILHQDQVGGLEVFANNKWQAIRPRPDALVVNIGDTFTALSNGRYQSCLHRAVVNRERERKSLVFFVSPKEEKVVRPPQDLVCREGPRKYPDFTWSDLLEFTQKHYRADVATLQSFIQWLLSAKP

SEQ ID NO: 766 - DNA, 1137 bp, Populus trichocarpa
  misc_feature (1)..(1137): Ceres Annot ID no. 1509446
  misc_feature (1)..(1137): Encodes the peptide sequence at SEQ ID NO. 767
atggactcaacttcttcaagtcttctcttgtgtcctcctccgtatcttacaaaagatgaaactggggctcttgtttttgactcatctttcttgcaaaaacaagccagcttgcccacagagttcatgtggccacatggagacttagttcacaacgaagatgagcttaaagagccaatgatagacttggaaggattccttaaaggtgatgaggttgcaactgctcaagctgctgagcttgttaggactgcttgcttgaaccatggcttctttcaagtcaccaaccatggtgttgatataagtctcattcatagtgctcatgaagagattggcaagattttcaaactgcctcttgacaagaaactcagtgtccgtagaaagccaggtgatgtgagtggatattctggtgcccatgcacatcgatattcatccaagttgccatggaaggagacattttcttttggctaccacggggatgatgattctgtgccacttgttgttgactacttcaagtccgtcttaggaaaagattttgaacacactgggtgggtttaccaaagttactgtgaagcaatgaagaaagtatccctagtgatatttgagctgttggccatcagcctaggagttgatcgtttacactatcgcaaattctttgaagatggaagctcaataatgaggtgtaactattatccaccttgcaataattctaccctcactcttggcactggtcctcactgtgacccaacttccttaacaatacttcaccaagaccaagttggtggtcttcaagtcttttcaaacaacaaatggctagcaatccgacctcgtccagatgccctagttgtaaacattggtgataccttcatggcactatccaatgggagatacaaaagttgccttcatagagcagtggtgaacagggacagcgagagaagatcactggttttctttgtgagtccaaaagaggaaaaagtagtgagacccccacaagatcttgtttccagagaagggcaaaggatttacccggatttcacatggtcggatttgttggagttcacgcaaaagcactacagagctgatgtcgctacactccaaagcttcattcaatggctttcatcttctaaaccatctaccttttag

SEQ ID NO: 767 - protein, 378 aa, Populus trichocarpa
  misc_feature (1)..(378): Ceres Annot ID no. 1509446
  misc_feature (1)..(378): Public GI ID no. 224096043
  misc_feature (222)..(319): Pfam Name: 2OG-FeII_Oxy Pfam Description: 2OG-Fe(II) oxygenase superfamily
  misc_feature (1)..(378): Bit score of 540.5 for HMM based on sequences of Figure 1
  misc_feature (1)..(378): Functional Homolog Of SEQ ID NO. 471
MDSTSSSLLLCPPPYLTKDETGALVFDSSFLQKQASLPTEFMWPHGDLVHNEDELKEPMIDLEGFLKGDEVATAQAAELVRTACLNHGFFQVTNHGVDISLIHSAHEEIGKIFKLPLDKKLSVRRKPGDVSGYSGAHAHRYSSKLPWKETFSFGYHGDDDSVPLVVDYFKSVLGKDFEHTGWVYQSYCEAMKKVSLVIFELLAISLGVDRLHYRKFFEDGSSIMRCNYYPPCNNSTLTLGTGPHCDPTSLTILHQDQVGGLQVFSNNKWLAIRPRPDALVVNIGDTFMALSNGRYKSCLHRAVVNRDSERRSLVFFVSPKEEKVVRPPQDLVSREGQRIYPDFTWSDLLEFTQKHYRADVATLQSFIQWLSSSKPSTF

SEQ ID NO: 768 - protein, 385 aa, Populus nigra
  misc_feature (1)..(385): Public GI ID no. 28316358
  misc_feature (230)..(328): Pfam Name: 2OG-FeII_Oxy Pfam Description: 2OG-Fe(II) oxygenase superfamily
  misc_feature (1)..(385): Bit score of 737.8 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGRVYQDYCEAMSTLSLGIMELLGMSLGVSREHFREFFNENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 769 - protein, 365 aa, Selaginella moellendorffii
  misc_feature (1)..(365): Public GI ID no. 302821073
  misc_feature (217)..(314): Pfam Name: 2OG-FeII_Oxy Pfam Description: 2OG-Fe(II) oxygenase superfamily
  misc_feature (1)..(365): Bit score of 246.2 for HMM based on sequences of Figure 1
  misc_feature (1)..(365): Functional Homolog Of SEQ ID NO. 471
MPITTRSTMPSSTPAAEFFAAYLQDSVTQKLDLNAFVWPEGLRPETSSGGQFSNDVPEIDISAAMLAKNEGVRAAVAAKISKAAKEWGFFRIVNHGLPPDMMSRAERQAHKFFALQLDQKMRAAGSSSNPFGYAAAGPSRAIMRSWHETLYMLCNHARIDNLANKVWPVLAFHCSMALSDYTTAMNKLGLQLLELLLQGLGVDRNKLTRHYSVEGSSSARINFYPPCPKPDVTFGLPPHTDSGTLTILHQDAVGGLQVCRNGKWIGVQPKPNSFIVNIGDCLQVWSNNIYKSVEHRALVNSSRARMSLAFFYNPTDDTIVAPIKELTSAKTPAVYKPFSWAEYRLYAGTHKSKVLNAIDHFKVRQ

SEQ ID NO: 770 - protein, 304 aa, Glycine max
  misc_feature (1)..(304): Public GI ID no. 217037951
  misc_feature (187)..(250): Pfam Name: 2OG-FeII_Oxy Pfam Description: 2OG-Fe(II) oxygenase superfamily
  misc_feature (1)..(304): Bit score of 214.3 for HMM based on sequences of Figure 1
  misc_feature (1)..(304): Functional Homolog Of SEQ ID NO. 471
MAIECITNIQSMSQPQKHHQDHKEDEAPLVFDASLLRHELNLPKQFIWPDEEKPCMNVPELAVPLIDLGGFISGDPVATMEAARMVGEACQKHGFFLVVNHGIDAKLISHAHSYMDDFFEIPLSQKQRAQRKTGEHCGYASSFTGRRVYQDYCDAMSNLSLGIMELLGMSLGVGKACFSEFFEENNSIMRLNYYPPCQKPDLTLGTGPHCDPTSLTILHQDQVGGLQVFVDNEWHSVSPNFNAFVVNIGDKVVSPPSELVDDLTPRVYPDFTWPMLLEFTQKHYRADIKTLEAFTNWLLQRKTN

SEQ ID NO: 771 - DNA, 1410 bp, Glycine max
  misc_feature (1)..(1410): Ceres Clone ID no. 526491
  misc_feature (1)..(1410): Encodes the peptide sequence at SEQ ID NO. 772
atgcaaaaatgtctcctcccctaatggaattaagtgcttccactctagtactttaccctgcatcacagccaccacaagagcctaaaaatgagaacaatgggggcatagtttttgactcaaaaaatttgcagcaaatgcaaggggaaatgcccaaagagttcctttggccttctagggacttggttgacaccacccaagaggagctaaaggaaccccttgtggacctagcaatctttaagaatggtgacgagaaagctatttccaatgcagcagagcttgtgagaaaagcatgcttgaagcatgggtttttccaagtgataaaccatggtgtggacccagatctcattgatgctgcatatcatgaaattgactccatttttaagctcccattgagcaaaaagatgggtgctaagagaaaacctggtggtgtctcagggtactctggtgctcatgcagatcgttattcgtccaagttgccatggaaagagacgttttctttcctctatgatcaccaaagcttctccaactcccagattgttgactacttcaagtctgtgttaggggaggatcttcaacacacagggagggtatatcaaaagtactgcgaggcaatgaaggatttatctttagtaattatggagctattgggtattagtttgggtgtggatcgtgagcattatcgaagattttttcaagatggtgactcaataatgaggtgcaactattatccaccttgcaacagagcgaacctcaccttaggcactggccctcacactgatccaacctcactaaccattcttcatcaagaccaagttggaggtttagaagtttttgtagataacaaatggctcgctgttcgccctcgatctgaagccttagtcataaacataggtgatactttcatggcattgtcaaatgggagatacaagagttgtctacacagggcattggtgaacacatacagggagagaaggtcccttgtttattttgtgtgtccaagagaagacaaaatagtgaggcccccagacaatttgttatgcagaaatgaggaaaggaagtaccctgatttcacatggtccaatttgtttgaattcacacagaagcactatagggctgatgttgctaccctccaaagcttcattgagtggcagcaatgctctaattccaacccttccaacctctagtttactttatttaccctttggctgcttattattattgcttttgcctgtgcctggctgcctaatgtcaccactactactactccctttggctaatcattattcattttccttttcttttgaaataccctgtacggagtttgagtacagctcatcctgcacttacaaaccacatagtgatatcatgtacggtcgtatttgaatcaagttccattttctgttatctgtc

SEQ ID NO: 772 - protein, 391 aa, Glycine max
  misc_feature (1)..(391): Ceres Clone ID no. 526491
  misc_feature (233)..(330): Pfam Name: 2OG-FeII_Oxy Pfam Description: 2OG-Fe(II) oxygenase superfamily
  misc_feature (1)..(391): Bit score of 529.9 for HMM based on sequences of Figure 1
  misc_feature (1)..(391): Functional Homolog Of SEQ ID NO. 471
MSPPLMELSASTLVLYPASQPPQEPKNENNGGIVFDSKNLQQMQGEMPKEFLWPSRDLVDTTQEELKEPLVDLAIFKNGDEKAISNAAELVRKACLKHGFFQVINHGVDPDLIDAAYHEIDSIFKLPLSKKMGAKRKPGGVSGYSGAHADRYSSKLPWKETFSFLYDHQSFSNSQIVDYFKSVLGEDLQHTGRVYQKYCEAMKDLSLVIMELLGISLGVDREHYRRFFQDGDSIMRCNYYPPCNRANLTLGTGPHTDPTSLTILHQDQVGGLEVFVDNKWLAVRPRSEALVINIGDTFMALSNGRYKSCLHRALVNTYRERRSLVYFVCPREDKIVRPPDNLLCRNEERKYPDFTWSNLFEFTQKHYRADVATLQSFIEWQQCSNSNPSNL

SEQ ID NO: 773 - protein, 341 aa, Populus trichocarpa
  misc_feature (1)..(341): Public GI ID no. 224082360
  misc_feature (185)..(282): Pfam Name: 2OG-FeII_Oxy Pfam Description: 2OG-Fe(II) oxygenase superfamily
  misc_feature (1)..(341): Bit score of 490.2 for HMM based on sequences of Figure 1
  misc_feature (1)..(341): Functional Homolog Of SEQ ID NO. 471
MPRRFVWPKQDLVGAHQELTEPVVDLEGFFRGDEEAIKQASDIIKAACLQHGFFQVINHGVDLNLISLAHDHMHNFFKLPTCDKLRVRRMPGSIWGYSSGHADRYLSKLPWKETLSFGYNENCPNPIGIDFFKSTLGKDFEQTGLVYLKYCEAMKGLSLSIMELLAISLGVDRGYYKSFFEDGCSIMRCNFYPPCQEPGLILGTGPHRDPTSLTILHQDQVGGLEVFSDNVWQTVRPRQSALVINIGDTFMALSNGTYKSCLHRAVVNKYEERRSLAFFLCPKEDKVVRPPLDLVCNQGRRMYPDFTWSDLLHFTQKYYRADDATLQNFTKWIISLKSASL

SEQ ID NO: 774 - DNA, 1158 bp, Arabidopsis thaliana
  misc_feature (1)..(1158): Ceres Annot ID no. 835213
  misc_feature (1)..(1158): Encodes the peptide sequence at SEQ ID NO. 775
atgtgcatatatgcatctagacagactgtctgcccctatttaacccccttcaaagttaaaagacccaagtcaagagaaatgaattcctccgacgtcaacttctccctactccagagccaaccaaatgttccggctgaattcttctggccggagaaagacgttgccccttcagaaggcgacctcgatctcccaatcatcgacttgagtgggttcttgaatggcaatgaggccgagacgcaacttgcagctaaggcagtgaaaaaagcgtgcatggctcacggtacttttctagtggtcaatcatggcttcaagtcgggcttggctgaaaaggcgcttgagatatcgagtttgttctttgggctatccaaggatgagaagctaagggcttataggatcccggggaatatctctggctataccgcaggtcatagccaaagattttcctccaatcttccgtggaatgagactttgactttggccttcaaaaaggggccaccccatgttgttgaagactttctaacctcaaggctaggcaaccatcgtcaagagatcggtcaagtgtttcaagaattttgtgatgcaatgaatggactggttatggatttgatggagctattgggtataagtatgggtttaaaagacaggacatactaccggagattcttcgaagatggaagtggcatcttcagatgcaactattatccgccgtgcaagcagccagagaaagcccttggtgttggcccccataatgacccaacggctataaccgttttgcttcaagacgatgttgtgggcttagaggtctttgccgcaggtagttggcagaccgttcgccctcgtcctggtgctcttgtcgtcaacgttggagacaccttcatggcattgtcaaatggaaactacaggagttgttaccacagggcagtggtaaacaaggagaaagtgagaaggtcattagtattcttctcttgtcctagagaagataaaatcatcgtacctcctcctgaacttgtggaaggtgaagaagcttctagaaagtaccctgactttacttgggctcagcttcagaaatttacccagtccggctatcgagtcgataacaccactctccataacttctcttcgtggctcgtctctaactccgacaagaaatcaacttga

SEQ ID NO: 775 - protein, 385 aa, Arabidopsis thaliana
  misc_feature (1)..(385): Ceres Annot ID no. 835213
  misc_feature (1)..(385): Public GI ID no. 15219344
  misc_feature (229)..(324): Pfam Name: 2OG-FeII_Oxy Pfam Description: 2OG-Fe(II) oxygenase superfamily
  misc_feature (1)..(385): Bit score of 427.0 for HMM based on sequences of Figure 1
  misc_feature (1)..(385): Functional Homolog Of SEQ ID NO. 471
MCIYASRQTVCPYLTPFKVKRPKSREMNSSDVNFSLLQSQPNVPAEFFWPEKDVAPSEGDLDLPIIDLSGFLNGNEAETQLAAKAVKKACMAHGTFLVVNHGFKSGLAEKALEISSLFFGLSKDEKLRAYRIPGNISGYTAGHSQRFSSNLPWNETLTLAFKKGPPHVVEDFLTSRLGNHRQEIGQVFQEFCDAMNGLVMDLMELLGISMGLKDRTYYRRFFEDGSGIFRCNYYPPCKQPEKALGVGPHNDPTAITVLLQDDVVGLEVFAAGSWQTVRPRPGALVVNVGDTFMALSNGNYRSCYHRAVVNKEKVRRSLVFFSCPREDKIIVPPPELVEGEEASRKYPDFTWAQLQKFTQSGYRVDNTTLHNFSSWLVSNSDKKST

SEQ ID NO: 776 - protein, 385 aa, Populus tremula
  misc_feature (1)..(385): Public GI ID no. 53139612
  misc_feature (230)..(328): Pfam Name: 2OG-FeII_Oxy Pfam Description: 2OG-Fe(II) oxygenase superfamily
  misc_feature (1)..(385): Bit score of 729.6 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTSSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPENDKMVTPPHELVDTCNPRIYPDFTWPMLLEFTQKHYRADMKTLEVFTNWLHQRSFS

SEQ ID NO: 777 - protein, 385 aa, Populus trichocarpa
  misc_feature (1)..(385): Public GI ID no. 224120176
  misc_feature (230)..(328): Pfam Name: 2OG-FeII_Oxy Pfam Description: 2OG-Fe(II) oxygenase superfamily
  misc_feature (1)..(385): Bit score of 722.2 for HMM based on sequences of Figure 1
  misc_feature (1)..(385): Functional Homolog Of SEQ ID NO. 471
MAIDCIKTMPSKTTHHHHPKDQDQCKDDNKSLVFDAQVLRYQSSIPQQFIWPDHEKPSANAPKLQVPLIDLGDFLSGNPDAAMEASRLVGEACQKHGFFLVVNHGVDKTLIAHALNYMDNFFELPLSEKQKAQRKIGESCGYASSFTGRFSSKLPWKETLSFSYTAEKNSSKHIEQYFHDRMGEDFAKFGRVYQDYCEAMSTLSLGIMELLGMSLGVSRAHFREYFEENDSIMRLNYYPPCQKPELTLGTGPHCDPTSLTILHQDQVGGLQVYVDNEWCSISPNFDAFVVNIGDTFMALSNGRYKSCLHRAVVNSQTPRKSLAFFLCPRNDKKVTPPKELVDTCNPRIYPDFTWPMLLEFTQKHYRADMKTLEMFTNWLQQRNVS

SEQ ID NO: 778 - protein, 394 aa, Oryza minuta
  misc_feature (1)..(394): Public GI ID no. 210142294
  misc_feature (232)..(329): Pfam Name: 2OG-FeII_Oxy Pfam Description: 2OG-Fe(II) oxygenase superfamily
  misc_feature (1)..(394): Bit score of 491.7 for HMM based on sequences of Figure 1
  misc_feature (1)..(394): Functional Homolog Of SEQ ID NO. 471
MVAEPPTPPQHQPTSAVTPPMDSTGSGIAAPGATAAAVCDLRLEPKIPEPFVWPNADARPASAAELDMPVVDVGVLLNGDAEGLRRAAEQVAAACATHGFFQVSGHSVDAALARAALDGASDFFRLPLAEKRRARRVPGTVSGYTSAHADRFASKLPWKETLSFGFHDRGAAPVVADYFSSTLGPDFAPMGRVYQKYCEEMKELSLTIMELLELSLGVERGYYREFFADSSSIMRCNYYPPCPEPERTLGTGPHCDPTALTILLQDHVGGLEVLVDGDWRPVSPVPGAMVINIGDTFMALSNGRYRSCLHRAVVNRRQERRSLAFFLCPREDRVVRPPPSAATPRQYPDFTWADLMRFTQRHYRADTRTLDAFTRWLTPPPDAAAATAQVEAAS

SEQ ID NO: 779 - protein, 379 aa, Lactuca sativa
  misc_feature (1)..(379): Public GI ID no. 9971219
  misc_feature (224)..(322): Pfam Name: 2OG-FeII_Oxy Pfam Description: 2OG-Fe(II) oxygenase superfamily
  misc_feature (1)..(379): Bit score of 638.0 for HMM based on sequences of Figure 1
  misc_feature (1)..(379): Functional Homolog Of SEQ ID NO. 471
MPPFLLPSPSRLPKKETNFRNNPFIFDASFLQNETSIPQQFMWPEDEKPHLDLPLPQLRVPPIDLNDFLTGDSLAVCNAAQLVDAACREHGFFQVVNHGIDQRLINEAHKIMDLFFGMPLLEKQKAQRKVGEYCGYASSFTNRFSSKLPWKETLSVRYSADPLSSNLVQDYFLKVMGEDFSYLGRVCQEYCEAMSKLSLSIIELLGMSLGIGQSYFRDFYEENDSIMRLNYYPPCQKPDQTLGTGPHCDPTSLTILHQDNVGGLEVFVDEKWHSIAPCSEAFVVNIGDTFMALSNGLYKSCLHRAVVNNHTPRKSLAFFLSPRMDKVVCPPKPLVEDVDKQRRYPDFTWSTFLEFTQKHYRADKNTLDAFSNWLKNGRK

SEQ ID NO: 780 - protein, 365 aa, Trichophyton equinum
  misc_feature (1)..(365): Public GI ID no. 326475334
  misc_feature (1)..(365): Trichophyton equinum CBS 127.97
  misc_feature (195)..(307): Pfam Name: 2OG-FeII_Oxy Pfam Description: 2OG-Fe(II) oxygenase superfamily
  misc_feature (1)..(365): Bit score of 83.7 for HMM based on sequences of Figure 1
  misc_feature (1)..(365): Functional Homolog Of SEQ ID NO. 471
MTKEYVEPANIPIIDFRALTSENPQERKGALNQLDEAFQTYGFIYLSNHSIGQKLVDEAFSWSQRFFHLPSETKALCKHQTVAADHRGWAAVGTGIVSQDVWDKNEIEKLRKTAPIEQKEILEMGNPHSKGGPGESIVNRLLPDDVFPGFRAFIEKWWDACFKQQLEVLRALCEILGYTDLDYLGKQQDPSRSRNHMSWLYYLSQPVAPLRSGESNRLNTHTDFTQLTLLFQDMVGGLEVHDYDAGIFRPVLPKPGTMIVHVGDMLEKQSNGKWKSALHHVSAPSHLKYGDEKANEDTVVERFSMSFYGTPQHDVMIQPIPGCEAAGKWQTLQWEPNMTAGDWIHKRVALEYGDGQQAPQVVSAA

SEQ ID NO: 781 - protein, 378 aa, Ricinus communis
  misc_feature (1)..(378): Public GI ID no. 255539617
  misc_feature (225)..(323): Pfam Name: 2OG-FeII_Oxy Pfam Description: 2OG-Fe(II) oxygenase superfamily
  misc_feature (1)..(378): Bit score of 732.5 for HMM based on sequences of Figure 1
  misc_feature (1)..(378): Functional Homolog Of SEQ ID NO. 471
MAIECIKAVPSSVHQKEERSKEEQKSLVFDAKFLRYQSNIPQQFVWPDDEKPIVNAPELAVPLIDLGGFLSGDPVSATEASKLVGEACQKHGFFLVVNHGVDQKLIADAHRYMDNFFELPLSDKQKAQRKVGEHCGYASSFTGRFSTKLPWKETLSFRYSAQQNSPKLVQDYFHNTMGESFLEFGKVYQQYCEAMSTLSLGIMELLGMSLGVSKAHFREFFEENDSIMRLNYYPPCQKPDLTLGTGPHCDPTSLTILHQDQVGGLQVYVDNEWRSISPNFQAFVVNIGDTFMALSNGKYKSCLHRAVVNSETTRKSLAFFLCPKSDKMITPPTKLVDNSNPRIYPDFTWSMLLEFTQKHYRADMKTLEMFSNWVQQRK

SEQ ID NO: 782 - protein, 359 aa, Dasypyrum villosum
  misc_feature (1)..(359): Public GI ID no. 255927109
  misc_feature (201)..(299): Pfam Name: 2OG-FeII_Oxy Pfam Description: 2OG-Fe(II) oxygenase superfamily
  misc_feature (1)..(359): Bit score of 694.3 for HMM based on sequences of Figure 1
  misc_feature (1)..(359): Functional Homolog Of SEQ ID NO. 471
MVQPVFDSAVLSGRADIPSQLIWPEGESPTPDAAEELHVPLIDIGGMLSGDPRAAAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSQLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCPEMDKVVAPPGALVDAANPRAYPDFTWRSLLDFTQKHYRADMKTLEVFSSWVVQQQQAAMT

SEQ ID NO: 783 - protein, 364 aa, Solanum lycopersicum
  misc_feature (1)..(364): Public GI ID no. 186695270
  misc_feature (211)..(309): Pfam Name: 2OG-FeII_Oxy Pfam Description: 2OG-Fe(II) oxygenase superfamily
  misc_feature (1)..(364): Bit score of 626.5 for HMM based on sequences of Figure 1
  misc_feature (1)..(364): Functional Homolog Of SEQ ID NO. 471
MHDERQNDEETSLVFDFLANNSNIPPQFIWPDDEKPCPQPPPLLHVPPIDLNGYLSGDPLAVSNATRLVNEACRKHGFFLVVNHGIDTKLINEAHKNMDFFFGKPLVEKEKAKRKVGDYCGYASSFTSRFSCNLPWKETLSFRYSAELPFSHHIVQNYILNVMGQEYTHFGDVYQKYCEEMSKLSLSVMELLGESIGVGRSYFREFFEENDSIMRLNYYPICQKPDLTLGTGPHCDPTSLTILHQDDVGGLEVFVDDKWHSIPTNTNAFVVNIGDTFMVMSNGTYKSCLHRAIVNCRRTRKSLAFFLCPKQDKIVSPPKELITKNLPRKFPDFTWPLFLEFTQKHYRADKNTLDAFVHWLLHKT

SEQ ID NO: 784 - protein, 375 aa, Solanum tuberosum
  misc_feature (1)..(375): Public GI ID no. 10800976
  misc_feature (1)..(375): Solanum tuberosum subsp. andigenum
  misc_feature (220)..(317): Pfam Name: 2OG-FeII_Oxy Pfam Description: 2OG-Fe(II) oxygenase superfamily
  misc_feature (1)..(375): Bit score of 686.7 for HMM based on sequences of Figure 1
  misc_feature (1)..(375): Functional Homolog Of SEQ ID NO. 471
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 785 - protein, 359 aa, Dasypyrum villosum
  misc_feature (1)..(359): Public GI ID no. 255927097
  misc_feature (201)..(299): Pfam Name: 2OG-FeII_Oxy Pfam Description: 2OG-Fe(II) oxygenase superfamily
  misc_feature (1)..(359): Bit score of 691.8 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHPCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 786 - DNA, 853 bp, Gossypium hirsutum
  misc_feature (1)..(853): Ceres Clone ID no. 100062984
  misc_feature (1)..(853): Encodes the peptide sequence at SEQ ID NO. 787
attcaataatgaggctgaattactatccgccttgccaaaaaccagacctcactttaggaacggggcctcattgcgatccaacgtctttaaccatccttcaccaagaccgagttggtggtcttcaagtgtttgtagacaacgaatggcgttcaatcagcccaaatttcgaagcatttgttgttaacattggcgacaccttcatggctttatcaaatggaagatacaaaagttgcttgcaccgggcggttgtgaacagccacaccccaagaaaatcccttgctttctttttgtgcccaaagggtgataaagtggttaccccaccaaaagagttggtggacgcatatagccccagagtatatccagattttacatggccaatgctgcttgaattcacacaaaagcactacagagctgacatgaatacgcttgaagtattctcaaactgggttcaacagagaagccgctgaaccgctgttgtctctaccgtcttgtaaattagctaggtgtgattacaaaacagacatggcatatcactggcctctctgccaagaacatgacacttgatgggtggacagaaaactgattcaagtgctgggatttttgctacgagttgaaggcaaggtcaggggataaggggtcaggtgacaagcattttaagtgatgaaatgaaatacaagacatgagatgctacgaggaacccaataaacagctcgaccatcactaattttttttgtatctcctttgagaatatagaaagctatcaatagaattacctctcttcatgtaaaaacaaaattaggctacttaattgctaggttctttcttttgttattatatttcaagcaacttcttc

SEQ ID NO: 787 - protein, 152 aa, Gossypium hirsutum
  misc_feature (1)..(152): Ceres Clone ID no. 100062984
  misc_feature (1)..(96): Pfam Name: 2OG-FeII_Oxy Pfam Description: 2OG-Fe(II) oxygenase superfamily
  misc_feature (1)..(152): Bit score of 338.3 for HMM based on sequences of Figure 1
  misc_feature (1)..(152): Functional Homolog Of SEQ ID NO. 471
MRLNYYPPCQKPDLTLGTGPHCDPTSLTILHQDRVGGLQVFVDNEWRSISPNFEAFVVNIGDTFMALSNGRYKSCLHRAVVNSHTPRKSLAFFLCPKGDKVVTPPKELVDAYSPRVYPDFTWPMLLEFTQKHYRADMNTLEVFSNWVQQRSR

SEQ ID NO: 788 - protein, 367 aa, Beta vulgaris
  misc_feature (1)..(367): Public GI ID no. 115361480
  misc_feature (212)..(309): Pfam Name: 2OG-FeII_Oxy Pfam Description: 2OG-Fe(II) oxygenase superfamily
  misc_feature (1)..(367): Bit score of 664.6 for HMM based on sequences of Figure 1
  misc_feature (1)..(367): Functional Homolog Of SEQ ID NO. 471
MQALLTVPTPVPEFNTSILKHEHNIPTQFIWPDDEKPGSQTPPELQVPPIDLGGFLSGDPVAVSNSTRLANEACKKHGFFLVFNHGVDSKLLAKAHEAMDVFFEQPFSQKQRALRKQGDHCGYASSFVGRFATKLPWKETLSFPYSADHKSSNMVEDYFFNKMGSEFQEFGKVYQEYCKAMSNLSLGIMELLGMSLGVERSHFRDFFEENESIMRLNYYPPCLKPDLTLGTGPHCDPTSLTILHQDHVGGLEVFVDQKWYSIRPNSEAFVVNIGDTFMALSNGIYKSCLHRAVVNSETPRKSLAFFLCPRGDKVISPPNELMEDLKSLRVYPDFTWQLFLEFTQKHYRADMKTLDTFTKWLQNRREQ

SEQ ID NO: 789 - protein, 382 aa, Phaseolus vulgaris
  misc_feature (1)..(382): Public GI ID no. 2262201
  misc_feature (228)..(326): Pfam Name: 2OG-FeII_Oxy Pfam Description: 2OG-Fe(II) oxygenase superfamily
  misc_feature (1)..(382): Bit score of 722.8 for HMM based on sequences of Figure 1
  misc_feature (1)..(382): Functional Homolog Of SEQ ID NO. 471
MAIDCMTNIQTMSQPQKHHHQDNKEDEAPLVFDASLLRHQLNLPKQFIWPDDEKPCMNVPELVVPLIDLRGFLSGDPVATMEAARMVGEACQKHGFFLVVNHGIDANLISHAHSYMDDFFEVPLTQKQRAQRKTGEHCGYASSFTGRFSSKLPWKETLSFQFSAEEKSSTIVKDYLCNTLGQEFEQFGRVYQDYCDAMSNLSLGIMELLGMSLGVGKACFREFFEENDSIMRLNYYPPCQKPDLTLGTGPHCDPTSLTILHQDQVGGLQVFVDNEWHSINPNFNAFVVNIGDTFMALSNGRYKSCLHRAVVNSKTTRKSLAFFLCPKGDKVVSPPSELVDDLTPRLYPDFTWPMLLEFTQKHYRADMKTLEAFTNWLQQKRS

SEQ ID NO: 790 - protein, 367 aa, Nicotiana tabacum
  misc_feature (1)..(367): Public GI ID no. 3327247
  misc_feature (213)..(311): Pfam Name: 2OG-FeII_Oxy Pfam Description: 2OG-Fe(II) oxygenase superfamily
  misc_feature (1)..(367): Bit score of 644.8 for HMM based on sequences of Figure 1
  misc_feature (1)..(367): Functional Homolog Of SEQ ID NO. 471
MHDETQNEKTTSLVFDALFLQNNSNIPQQFIWPEGERPCPEPPPPLHVPPIDLNDYLSGDPLAVSNATRLVNQACRKHGFFLVVNHGIDSKLINEAHKNMDFFFEKPLVEKERAKRKLGDYCGYASSFTSRFSCNLPWKETLSFRYSAEVPSSQHIVQSYILNVMGQDYTHFGNVYQKYCEEMSKLSLKVMELLGESLGVGRAYFREFFEGNDSIMRLNYYPPCKKPDLTLGTGPTCDPTSLTILHQDNVGGLEVFVDEKWYSIPPNTNAFVVNIGDTFMVMSNGTYKSCLHRAVVNSRKPRKSLAFFLCPKKDKIVSPPKELITRNVPRKFPDFTWPVFLEFTQKHYRADKKTLDAFVHWLLHKGY

SEQ ID NO: 791 - protein, 389 aa, Oryza rufipogon
  misc_feature (1)..(389): Public GI ID no. 335056001
  misc_feature (227)..(324): Pfam Name: 2OG-FeII_Oxy Pfam Description: 2OG-Fe(II) oxygenase superfamily
  misc_feature (1)..(389): Bit score of 494.4 for HMM based on sequences of Figure 1
  misc_feature (1)..(389): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGADFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 792 - protein, 354 aa, Frankia alni
  misc_feature (1)..(354): Public GI ID no. 111225835
  misc_feature (1)..(354): Frankia alni ACN14a
  misc_feature (213)..(294): Pfam Name: 2OG-FeII_Oxy Pfam Description: 2OG-Fe(II) oxygenase superfamily
  misc_feature (1)..(354): Bit score of 38.0 for HMM based on sequences of Figure 1
  misc_feature (1)..(354): Functional Homolog Of SEQ ID NO. 471
MIPVIDISPDVDSPAGAQVAAAIGRACREIGFFQVVGHGVPAAVIDSAYAAVARFLAWPTEEKARLEHPHPFRGWSSHRRVGCDTDMQRFQACAVPSAAEAAALGVEERYLDYFQLCPWPDDVAFQEAFSAHFAAVRAVGRTLMSYFAVTLGLPSDYFAPALRHDVSDMAANHYHRADPADPADPTDPTGPADPIAADAHPVEAADLDTIDIVLPEHADSGMLTLLHQRGDYDGLQVRLLDGEVLTVPVRDDALVVNVGLLMSRWTNDQFLATRHRVAVPPRPGMTRTSLTTFCYPAVDTVIEPLATCVGADGPHYGPVTPYGWEAQYLAAQAAQYAANGELTPRVPLAPRQRG

SEQ ID NO: 793 - protein, 371 aa, Jatropha curcas
  misc_feature (1)..(371): Public GI ID no. 317106632
  misc_feature (217)..(315): Pfam Name: 2OG-FeII_Oxy Pfam Description: 2OG-Fe(II) oxygenase superfamily
  misc_feature (1)..(371): Bit score of 682.0 for HMM based on sequences of Figure 1
  misc_feature (1)..(371): Functional Homolog Of SEQ ID NO. 471
MSPPEPPQRADHVEQEKEPLVFELILQHESNIPSQFIWPEDEKPCLDSPQLEIPPIDLGSFLSRDPKVEAKTIELVNEACKKHGFFLVVNHGVDSQLIAKAHEYMDIFFRMPLAEKQRAQRKIGEHCGYASSFTGRFSSKLPWKETLSFRYSADDNLSNIVQEYFINVMGPDFKQFGQVYQEYCEAMNSLSLGIMELLGISLGLGRAYFREFFQENDSIMRLNHYPPCQKPDFTLGTGPHCDPTSLTILHQDEVGGLQVFVDDKWHAVRPDPQAFVVNIGDTFMALSNGIFKSCLHRAVVNNRRERKSLAFFLCPNMEKVVKPPHNLVDLKNPRKYPDFTWSTLLEFTQKHYRADMKTLDVFTTWLQQNNI

SEQ ID NO: 794 - protein, 359 aa, Dasypyrum villosum
  misc_feature (1)..(359): Public GI ID no. 255927087
  misc_feature (201)..(298): Pfam Name: 2OG-FeII_Oxy Pfam Description: 2OG-Fe(II) oxygenase superfamily
  misc_feature (1)..(359): Bit score of 686.9 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGAGRAHYRRFFEGNDSIMRLNYYPPCQRPYETLGTGPHCDPTSLTILHQDDVGGLQVHTEGRWRSIRPRADAFVVNIGDTFMALSNGRYKSCLHRAVVNSRVPRKSLAFFLCLEMDKVVAPPGTLVDAANPRAYPDFTWRSLLDFTQKHYRADMKTLEVFSSWVVQQQQAAMT

SEQ ID NO: 795 - protein, 271 aa, Arabidopsis thaliana
  misc_feature (1)..(271): Public GI ID no. 9791188
  misc_feature (224)..(269): Pfam Name: 2OG-FeII_Oxy Pfam Description: 2OG-Fe(II) oxygenase superfamily
  misc_feature (1)..(271): Bit score of 448.4 for HMM based on sequences of Figure 1
  misc_feature (1)..(271): Functional Homolog Of SEQ ID NO. 471
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCMKPDLTLGTGPHCDPTSLTILHQDHVNGLQVFVENQ

SEQ ID NO: 796 - protein, 377 aa, Arabidopsis thaliana
  misc_feature (1)..(377): Public GI ID no. 9791187
  misc_feature (224)..(322): Pfam Name: 2OG-FeII_Oxy Pfam Description: 2OG-Fe(II) oxygenase superfamily
  misc_feature (1)..(377): Bit score of 663.3 for HMM based on sequences of Figure 1
  misc_feature (1)..(377): Functional Homolog Of SEQ ID NO. 471
MAVSFVRTSPEEEDKPKLGLGNIQTPLIFNPSMLDLQANMANQFHWPDDEKPSTLQLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSERMRKSLAFFLCPKKDRVVTPPRELLDSITSRRYPDFTWSMFLEFTQKHYRADMNTLQAFSDWLTKPI

SEQ ID NO: 797 - protein, 377 aa, Chrysanthemum x morifolium
  misc_feature (1)..(377): Public GI ID no. 146270975
  misc_feature (224)..(321): Pfam Name: 2OG-FeII_Oxy Pfam Description: 2OG-Fe(II) oxygenase superfamily
  misc_feature (1)..(377): Bit score of 724.9 for HMM based on sequences of Figure 1
  misc_feature (1)..(377): Functional Homolog Of SEQ ID NO. 471
MAIDCMIKTTSNMPSLKEDQRKSFLFDASVLKHETNIPQQFIWPDHEKPNSQKSKELEVPLIDLGGFLSGRSSSANDASSLVGEACQKHGFFLVVNHGVDANLISDAQRYMDLFFELPLSVKQRAQRKVGESCGYASSFTGRFSSKLPWKETLSFRFSAEENASNIVKDYFENTMGEEFIRLGKVYQEYCNAMSRLSLGIMELLGMSLGVSRAYYKDFFEEHNSIMRLNYYPPCQKPDLTLGTGPHCDPTSLTILHQDNVGGLEVFVDNEWRLIVPNSNAFVVNIGDTFMALSNGRYKSCLHRAVVNSKTTRKSLAFFLCPKKDKVVIPPKELVDENNPRIYPDFTWSTFLEFTQKHYRADKNTLQAFSTWVRQKTT

SEQ ID NO: 798 - DNA, 1281 bp, Sorghum bicolor
  misc_feature (1)..(1281): Ceres Annot ID no. 8732690
  misc_feature (1)..(1281): Encodes the peptide sequence at SEQ ID NO. 799
atgccagagaacccacatcatggcagcagtgaccgccttgcccttgtgggcaagcaagttgatcgtcgcctactcctccccgtctctcctgccgccgacgacggcaaggacgacaacggcgccgctgctgtcatcaacctctggggccagctaaagatcccggacccgttcgtctggtcccacgccgaaacgatggtctcctcggagagggagctggacgcgccggtggtcgacgtcggcgccgccatgcgcggcggcgacgacgactgcggcgccgggatccgccgcgccgccgagctggtctccggggcgtgctcgagccacgggctcttccaggtgaccgggcacggcctggaccccgcgcttgcccgtgccgcgctcgacggcgccgccgccttcttccgcctgccgctcgccaccaagcagcgcgccagccgcgctccggggaacgtgaccggctacaccgccgcgcacgcagaccggttcacggccaatcttccctggaaggagacgctctccttcggccaccgtgaccgccggacatccggcagccatgttgtcgtggactacttcacctccacgctaggaagcgacttcaaacccttaggggtggtgtatcagaactactgcaacgcgatgaaggaggtgtcgctggcgataatggaggtgataggggtgagcctgggggtggggaggagctactacagggacttcttcgccgacggcagctccatcatgaggtgcaactactacccaccgtgcccggagccggagaggacgctggggacggggcctcactgcgacccgtcggcgctcaccgtcctgctgcaggacggcgacgtagacgggctccaggtgctcgtcgacggcgagtggcggaccgtgcggccgaggcccggcgcgctcgtcgtcagcatcggggacacattcatggcgctgtcgaacgggcggtaccggagctgcctccaccgcgcggtggtgcaccgggagcgggagcgccggtcgctggtcttcttcctctgcccgcgcgaggaccgcgtggtgcgcccgccgccgcgcctcctcctcgccgtcgccgcacgcgagcagcagcaggagcagccgcggcggaggtacccggacttcacctgggcggacctggcgcgcttcacgcagcgacactaccgcgccgacgccggcacgctcgacgccttcgcgcgctggctcggcgccgcccccacctgcgccgcggcgacgtcggcggcgtcccagagcccagacaaggcccacgagacagtttag

SEQ ID NO: 799 - protein, 426 aa, Sorghum bicolor
  misc_feature (1)..(426): Ceres Annot ID no. 8732690
  misc_feature (1)..(426): Public GI ID no. 242090569
  misc_feature (244)..(342): Pfam Name: 2OG-FeII_Oxy Pfam Description: 2OG-Fe(II) oxygenase superfamily
  misc_feature (1)..(426): Bit score of 448.5 for HMM based on sequences of Figure 1
  misc_feature (1)..(426): Functional Homolog Of SEQ ID NO. 471
MPENPHHGSSDRLALVGKQVDRRLLLPVSPAADDGKDDNGAAAVINLWGQLKIPDPFVWSHAETMVSSERELDAPVVDVGAAMRGGDDDCGAGIRRAAELVSGACSSHGLFQVTGHGLDPALARAALDGAAAFFRLPLATKQRASRAPGNVTGYTAAHADRFTANLPWKETLSFGHRDRRTSGSHVVVDYFTSTLGSDFKPLGVVYQNYCNAMKEVSLAIMEVIGVSLGVGRSYYRDFFADGSSIMRCNYYPPCPEPERTLGTGPHCDPSALTVLLQDGDVDGLQVLVDGEWRTVRPRPGALVVSIGDTFMALSNGRYRSCLHRAVVHRERERRSLVFFLCPREDRVVRPPPRLLLAVAAREQQQEQPRRRYPDFTWADLARFTQRHYRADAGTLDAFARWLGAAPTCAAATSAASQSPDKAHETV

SEQ ID NO: 800 - protein, 358 aa, Nerium oleander
  misc_feature (1)..(358): Public GI ID no. 51011362
  misc_feature (202)..(299): Pfam Name: 2OG-FeII_Oxy Pfam Description: 2OG-Fe(II) oxygenase superfamily
  misc_feature (1)..(358): Bit score of 513.2 for HMM based on sequences of Figure 1
  misc_feature (1)..(358): Functional Homolog Of SEQ ID NO. 471
MKNEILDFDMAALQKQSKLPTQFLWPYEDLVHTQDELREPVVNLEGFFRGDKEGTRNAAELIRTACLNHGIFQVINHGVDKDLIHDAYEHMDAFFKLPVGKKLSARREPGTLCGYSGAHAHRYSSKLPWKETLSFTYNHGSNFHVLNYFTSVLGNEFQETGLVYEKYCKAMENLCLVVMELLAISLGIEGLHYRKFFEDGCSLMRYNYYPPCKEFGLTFGTGPHCDPTSITILHQDQVGGLEVFANNKWKAVRPRSDAFVINIGGTFTALSNGRYKSCLHRAVVNKEKVRRSLVFFVCPKEDKVVRPPQDLIDREGPRKYPDFTWSDLLEFTQKHYRADVTTLQSFIHWFLPAKHDQN

SEQ ID NO: 801 - protein, 383 aa, Micromonas pusilla
  misc_feature (1)..(383): Public GI ID no. 303283824
  misc_feature (1)..(383): Micromonas pusilla CCMP1545
  misc_feature (194)..(323): Pfam Name: 2OG-FeII_Oxy Pfam Description: 2OG-Fe(II) oxygenase superfamily
  misc_feature (1)..(383): Bit score of 108.5 for HMM based on sequences of Figure 1
  misc_feature (1)..(383): Functional Homolog Of SEQ ID NO. 471
MAGRGRPPPAAFAVPTIDVSAFEGADATASDDVVRRVKEACERVGFFVVINHGVSDARARDAMAAARGFFARPLEEKMKIASLKKGYIPVGGCDNAVRPTNMHEKYSCSRVDGVDAVSDPYYDASASPDAALYFGEQNRWPESPSGFREAWEEYYRAMETLASRLMRMFALALGADAHHFETRIDKHVTNLVALRYPPLDLDLDARADADADEGPDETIVERVKPHTDPTTLTILAFETGEAGGLQVLPDRRGDGGDASGSDTGAEVDEWIDVPSVAGGLLVNLGDVMRFWTNDAWKSTRHRVVARRETLALDRLSLIFFHMPNYDAVVDAGDFGAAVVNDARPRKYPAFKSGERSHFNQLMRDEEGLPDRQTLKEGTNARGD

SEQ ID NO: 802 - protein, 259 aa, Grosmannia clavigera
  misc_feature (1)..(259): Public GI ID no. 320589215
  misc_feature (1)..(259): Grosmannia clavigera kw1407
  misc_feature (116)..(213): Pfam Name: 2OG-FeII_Oxy Pfam Description: 2OG-Fe(II) oxygenase superfamily
  misc_feature (1)..(259): Bit score of 55.8 for HMM based on sequences of Figure 1
  misc_feature (1)..(259): Functional Homolog Of SEQ ID NO. 471
MLRFFNAPHKDKNEIGLPSQEHGYEPIGNHAGLLDSTKDGYEIFKVSRDEISKTSPNLPFIVNNKGDIETLLSFIAGSNIITKTILSCLSTALGLTGAARLEYSHRNEHKSNSSLAMFRYIPGSLTTSKEIGHQKHTDIGSLTLLFSEQWGLQVLPPQSSTWAFVEPRPGHAVINVGDSLRFASEHMLYSCVHRVVPFNTADDRYSIAYFLRPENDAKFLDSQGRWVTASQWHDEKYDVFKVSHGQHSPADAILLGGMA

SEQ ID NO: 803 - protein, 359 aa, Dasypyrum villosum
  misc_feature (1)..(359): Public GI ID no. 255927089
  misc_feature (201)..(299): Pfam Name: 2OG-FeII_Oxy Pfam Description: 2OG-Fe(II) oxygenase superfamily
  misc_feature (1)..(359): Bit score of 692.0 for HMM based on sequences of Figure 1
  misc_feature (1)..(359): Functional Homolog Of SEQ ID NO. 471
MVQPVFDAALLSGRADIPSQFIWPEGESPTPDAAEELHVPLIDIGGMLSGDADAAAEVTRLVGQACERHGFFQVVNHGIDAELLADAHRCVDAFFTMPLPEKQRALRRPGESCGYASSFTGRFASKLPWKETLSFRSCPSDPALVVDYIVATLGEGHRRLGEVYARYCSEMSRLSLEIMEVLGESLGVGRAHYRRFFEGNDSIMRLNYYPPCQRPYETLGTGPHCDPTSLTILHQDDVGGLQVHTEGRWCSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 804 - protein, 331 aa, Gluconacetobacter
  misc_feature (1)..(331): Public GI ID no. 330992883
  misc_feature (1)..(331): Gluconacetobacter sp. SXCC-1
  misc_feature (188)..(293): Pfam Name: 2OG-FeII_Oxy Pfam Description: 2OG-Fe(II) oxygenase superfamily
  misc_feature (1)..(331): Bit score of 79.1 for HMM based on sequences of Figure 1
  misc_feature (1)..(331): Functional Homolog Of SEQ ID NO. 471
MTAQHDFPLVNLHEFETTSSTGRLEYGSRVDTICRRSGFLAITGHGVPADLIETMWDETRKFFDLPLEQKLKACPRQPGDPYGYFTVKSEALARSRAGMDRGPLLPDLKESFSCGPIHPLTGREGADELAFCYAPTPWSAVSPAFHATWIAYYDAMEKLAERIMRLFACALGLPEAYFNPYFRAPISSLRGLNYPEQDTAPQPGQIRAGAHSDYGTLTLLLPQQGSGGLEILGPDGQWQAVPAIPDAFVINIGDLMALWTNNRWVSTVHRVVNPPSSRKGQDRRQSLAFFQQPDWDSMIEALPNCVSTGHPPVFSPVRSGTYLMNKFRSTQ

SEQ ID NO: 805 - protein, 379 aa, Gossypium hirsutum
  misc_feature (1)..(379): Public GI ID no. 222875434
  misc_feature (226)..(323): Pfam Name: 2OG-FeII_Oxy Pfam Description: 2OG-Fe(II) oxygenase superfamily
  misc_feature (1)..(379): Bit score of 725.1 for HMM based on sequences of Figure 1
  misc_feature (1)..(379): Functional Homolog Of SEQ ID NO. 471
MAIDCVSKIPSMPHHPKDEKREEQKQLVFDASVLKYQPDIPKQFIWPDHEKPNVNAPELQVPFIDLGGFLSGDPVSAMEASRLVGEACRQHGFFLVVNHGVDATLVADAHSYMGNFLELPLNDKQRAQRKLGEHCGYASSFTGRFSSKLPWKETLSFRYSADKKSSKIVEDYLDGKLGDEFKHFGRVYQDYCEAMSKLSLGIMELLAISLGVGRSHFREFFEENESIMRLNYYPPCQKPDLTLGTGPHCDPTSLTILHQDRVGGLQVFVDNEWRSISPNVEAFVVNIGDTFMALSNGRYKSCLHRAVVNRHIPRKSLAFFLCPKGDKVVAPPTELVDAYNPRVYPDFTWPMLLEFTQKHYRADMNTLEVFSNWVQQRNS

SEQ ID NO: 806 - protein, 385 aa, Populus tremula
  misc_feature (1)..(385): Public GI ID no. 53139620
  misc_feature (230)..(328): Pfam Name: 2OG-FeII_Oxy Pfam Description: 2OG-Fe(II) oxygenase superfamily
  misc_feature (1)..(385): Bit score of 733.1 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 807 - protein, 377 aa, Arabidopsis lyrata
  misc_feature (1)..(377): Public GI ID no. 297799454
  misc_feature (1)..(377): Arabidopsis lyrata subsp. lyrata
  misc_feature (225)..(323): Pfam Name: 2OG-FeII_Oxy Pfam Description: 2OG-Fe(II) oxygenase superfamily
  misc_feature (1)..(377): Bit score of 672.2 for HMM based on sequences of Figure 1
  misc_feature (1)..(377): Functional Homolog Of SEQ ID NO. 471
MAVSFVTTSPEEEEAKPKLGLGNIQTPLIFNPSMLNLQPNIPNQFIWPDDEKPSIDVPELDVPLIDLQNLLSAPSSTLEASRQISEACKKHGFFLVVNHGISEKLISDAHEYTSRFFDMPLSEKQRVLRKPGESVGYASSFTGRFSTKLPWKETLSFRFCDDKSRSKSVQDYFCDALGHGFEPFGKVYQEYCEAMSSLSLKIMELLGLSLGVNRDYFRDFFGENDSIMRLNYYPPCQKPDLTLGTGPHCDPTSLTILHQDHINGLQVFVENQWRSIRPNPKAFVVNIGDTFMALSNDRYKSCLHRAVVNSESERKSLAFFLCPKNDRVVKPPTELLDSITSRRYPDFTWSMFLEFTQKHYRADMNTLQAFSDWLTKP

SEQ ID NO: 808 - protein, 346 aa, Caulobacter crescentus
  misc_feature (1)..(346): Public GI ID no. 304570785
  misc_feature (1)..(346): Caulobacter crescentus NA1000
  misc_feature (203)..(304): Pfam Name: 2OG-FeII_Oxy Pfam Description: 2OG-Fe(II) oxygenase superfamily
  misc_feature (1)..(346): Bit score of 84.1 for HMM based on sequences of Figure 1
  misc_feature (1)..(346): Functional Homolog Of SEQ ID NO. 471
MVKFPTTTPPGNEQPSFRPASGVVRRNLLIPRLADVSTSAIDPVSFSLYAKDFTRFAQELGASFERYGFAVLSDYDLDQARIDAAVDSAKAFFALPVETKKQYAGVKGGARGYIPFGVETAKGADHYDLKEFWHMGRDLPPGHRFRAHMADNVWPAEIPAFKHDVSWLYNSLDGMGGKVLEAIATYLKLERDFFKPTVQDGNSVLRLLHYPPIPKDATGVRAGAHGDINTITLLLGAEEGGLEVLDRDGQWLPINPPPGCLVINIGDMLERLTNNVLPSTVHRVVNPPPERRGVPRYSTPFFLHFASDYEIKTLQNCVTAENPDRYPESITADEFLQQRLREIKLA

SEQ ID NO: 809 - protein, 352 aa, Glycine max
  misc_feature (1)..(352): Public GI ID no. 89574458
  misc_feature (200)..(298): Pfam Name: 2OG-FeII_Oxy Pfam Description: 2OG-Fe(II) oxygenase superfamily
  misc_feature (1)..(352): Bit score of 237.3 for HMM based on sequences of Figure 1
  misc_feature (1)..(352): Functional Homolog Of SEQ ID NO. 471
MGEVDPAFIQEPQHRPNLSTIQAEGIPIIDLSPITNHTVSDPSAIESLVKEIGRACQEWGFFQVTNHGVPLTLRQNIEKASKLFFAQTLEEKRKVSRNESSPMGYYDTEHTKNVRDWKEVFDFLAKDLTFIPLTSDEHDDRVNQWTNQSPQYPPLFRVVTQEYIQEMEKLSFKLLELIALSLGLEAKRFEEFFIKDQTSFIRLNHYPPCPYPDLALGVGRHKDPGALTILAQDEVGGLEVRRKRDQEWIRVKPTPNAYIINIGDTVQVWSNDAYESVDHRVVVNSEKERLSIPFFFFPAHDTKVKPLEELINEQNPSKYRPYNWGKFLVHRGNSNFKKQNEENIQIHHYKIA

SEQ ID NO: 810 - protein, 318 aa, Aspergillus flavus
  misc_feature (1)..(318): Public GI ID no. 238507652
  misc_feature (1)..(318): Aspergillus flavus NRRL3357
  misc_feature (170)..(271): Pfam Name: 2OG-FeII_Oxy Pfam Description: 2OG-Fe(II) oxygenase superfamily
  misc_feature (1)..(318): Bit score of 55.8 for HMM based on sequences of Figure 1
  misc_feature (1)..(318): Functional Homolog Of SEQ ID NO. 471
MDKTDIAHLEVLSFAKLASKDQTELNRLLEACRKQGFFYLDLAGSNVSHGLHQRLKALSLMKDWFDRPNEEKMKLHKDSVTNGYKPPGTLSGVVKHMKDGFENIKLPRDNFLGTGDSLPEVFKNDKEVFRDDLEISHGVTLTILSCLSDLLQPPVRLEDYHQENMSSQSTMMYFRYAKQCADKSSGVGHNMHTDLGTLTLLYCEQWGLQVYAQATNSWKYVQPRPGLYVVNVGDALRFLSGNDLLSALHRVVPVPGHESEYRYSTAYFLRPGNETEFRTSENTVVSALNWHDQKYNVFKAAHVEQEKNTILTGGIGAF

SEQ ID NO: 811 - DNA, 1128 bp, Populus trichocarpa
  misc_feature (1)..(1128): Ceres Annot ID no. 1471005
  misc_feature (1)..(1128): Encodes the peptide sequence at SEQ ID NO. 812
atgacaattatgcctcctcctcctcctcctccagagccattagtatttgatgcttcaatccttcaacaccaagcgaacttaccctctcagttcatttggcctgaccacgaaaaaccatgccttgaacccccagaacttgcaatccctccgattgattttggaagcttcctcactggagatcctttggcggtctcaaaacttgcccagcaagtaaatgaggcatgcaagaagcatggtttctttgtaattgttaatcatggtgttgactcaaagcttatagctaaagctcatgagggtatgaacatgttctttggtaagcagctctcggagaagccagttcaaaggaagataggagagcaatatgggtatgccagtagcttcactggaagattctcctccaagcttccatggaaagaaacactttctttcagatattgtgctgacaatcagtcctctaacatcgtccaagaatacttcttgaatgtaatgggagaagaattcaaacagttcgggaaggtgtaccaagaatattgtgaagccatgaacactctttcccttggaattatggagctattaggagtaagtctaggagttggaaacgaatattttagagatttcttcgaaggaaatgattcaataatgagactaaattactaccctccttgccaaaaaccggaattaactcttggcactgggcctcactgtgatcctacatccttaacaattcttcatcaagatcatgtcagtggccttcaagtgttcgtcgaagaaaaatggcactccgttactcctgatccggaagctttcgtcgttaacattggtgacacattcatggctctatcaaatggcattttcaagagttgcttgcatagagcagtggtaaataacgtaacagtaaggaaatccctcgctttctttctatgtccaaaaatggacaaggtggtgaagccaccaaatactttggtcgactataaaaatccaagggtatatccggacttcacatggctagctttgtcagaattcacacaaaaacattacagggctgacatgaaaaccctagatgtcttcacaacatggcttcaacaaaaaaacaactgcgggggtaccaaaaatgcttcttcctgttaa

SEQ ID NO: 812 - protein, 372 aa, Populus trichocarpa
  misc_feature (1)..(372): Ceres Annot ID no. 1471005
  misc_feature (1)..(372): Ceres Annot ID no. 1524411
  misc_feature (208)..(306): Pfam Name: 2OG-FeII_Oxy Pfam Description: 2OG-Fe(II) oxygenase superfamily
  misc_feature (1)..(372): Bit score of 658.1 for HMM based on sequences of Figure 1
  misc_feature (1)..(372): Functional Homolog Of SEQ ID NO. 471
MPPPPPPPEPLVFDASILQHQANLPSQFIWPDHEKPCLEPPELAIPPIDFGSFLTGDPLAVSKLAQQVNEACKKHGFFVIVNHGVDSKLIAKAHEGMNMFFGKQLSEKPVQRKIGEQYGYASSFTGRFSSKLPWKETLSFRYCADNQSSNIVQEYFLNVMGEEFKQFGKVYQEYCEAMNTLSLGIMELLGVSLGVGNEYFRDFFEGNDSIMRLNYYPPCQKPELTLGTGPHCDPTSLTILHQDHVSGLQVFVEEKWHSVTPDPEAFVVNIGDTFMALSNGIFKSCLHRAVVNNVTVRKSLAFFLCPKMDKVVKPPNTLVDYKNPRVYPDFTWLALSEFTQKHYRADMKTLDVFTTWLQQKNNCGGTKNASSC

SEQ ID NO: 813 - protein, 372 aa, Oryza sativa
  misc_feature (211)..(309): Pfam Name: 2OG-FeII_Oxy Pfam Description: 2OG-Fe(II) oxygenase superfamily
  misc_feature (1)..(372): Bit score of 650.1 for HMM based on sequences of Figure 1
  misc_feature (1)..(372): Functional Homolog Of SEQ ID NO. 471
MSMVVQQEQEVVFDAAVLSGQTEFPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 814 - protein, 381 aa, Daucus carota
  misc_feature (1)..(381): Public GI ID no. 50428325
  misc_feature (226)..(323): Pfam Name: 2OG-FeII_Oxy Pfam Description: 2OG-Fe(II) oxygenase superfamily
  misc_feature (1)..(381): Bit score of 635.5 for HMM based on sequences of Figure 1
  misc_feature (1)..(381): Functional Homolog Of SEQ ID NO. 471
MATSQSSRPPHNFQHSYEDNNHHSQVVFDASIIQKETTIPKEFIWPDHEKPSLNTQELKVPLIDLGAFLSGDPSAAKESSILIGQACQEHGFFMVVNHGVDTNLISDAHKFMNLFFDLPLYVKQKAQRKLGENFGYASSFTGRFASKLPWKETFSFQYCADERMSSTTVKDYFTNKLGPDFAKLGKVYQDYSHAMSTLSLKIIDLLEISLGVSRSHFKNLFEDHDSIVRLNYYPPCQKPELTLGTGPHSDPTSLTILHQDHVAGLEVLVDDQWRCILPNTSAFVINIGDTLMAMTNGRYKSCLHRAVVNNETARKSIAFFLCPRKDKVVIPPAELVDQKNPRLYPDFTWAELLQFTQMHYRADMNTLDAFSTWLLTKNNRE

SEQ ID NO: 815 - protein, 372 aa, Oryza sativa
  misc_feature (1)..(372): Public GI ID no. 60390163
  misc_feature (1)..(372): Oryza sativa Japonica Group
  misc_feature (211)..(309): Pfam Name: 2OG-FeII_Oxy Pfam Description: 2OG-Fe(II) oxygenase superfamily
  misc_feature (1)..(372): Bit score of 647.3 for HMM based on sequences of Figure 1
  misc_feature (1)..(372): Functional Homolog Of SEQ ID NO. 471
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRLFQAFSDWLNHHRHLQPTIYS

SEQ ID NO: 816 - protein, 370 aa, Kalanchoe blossfeldiana
  misc_feature (1)..(370): Public GI ID no. 158392463
  misc_feature (212)..(310): Pfam Name: 2OG-FeII_Oxy Pfam Description: 2OG-Fe(II) oxygenase superfamily
  misc_feature (1)..(370): Bit score of 699.6 for HMM based on sequences of Figure 1
  misc_feature (1)..(370): Functional Homolog Of SEQ ID NO. 471
MAIEKQLQGEQTPLVFDASVLSHQTQIPKQFIWPDEEKPLPNLRELPVPLLDLNGFLAHDAAATNEAAKLVGEACEKHGFFLVVNHGVDAKLLADAHKYMDHFFDLPLAEKQRAQRKVGEHCGYASSFTGRFSSKLPWKETLSFRFSAEENKADIVREYFKSTMGEDFEHLGRVYQHYCKAMSRLSLGIMELLGMSLGVGRDYFRDFFEENDSIMRLNYYPPCQKPDQTLGTGPHCDPTSLTILHQDQVGGLQVFADNEWWSISPMADAFVVNIGDTFMALSNGRYKSCLHRAVVNSQSPRKSLAFFLSPKGDRVVSPPNQLVNPTVPRIYPDFTWPKLLEFTQKHYRADMNTLDAFSSWIQGHVLQYHT

SEQ ID NO: 817 - protein, 374 aa, Spinacia oleracea
  misc_feature (1)..(374): Public GI ID no. 1144390
  misc_feature (217)..(315): Pfam Name: 2OG-FeII_Oxy Pfam Description: 2OG-Fe(II) oxygenase superfamily
  misc_feature (1)..(374): Bit score of 636.8 for HMM based on sequences of Figure 1
  misc_feature (1)..(374): Functional Homolog Of SEQ ID NO. 471
MMQPLLTIPPPLPTTSLFDTSFLKHEDNIPSQFIWPDDEKPCSETPPELEVPPIDLGGFLSGDPVAVSKATTLANEACKWHGFFLIVNHDIYFELLVKAHEAMDYFFSQPFSQKQKALRKQGDHCGYASSFLGRFATKLPWKETLSFRYYDDDDDKSSKMVQNYISNLMGTDFQEFGRVYQEYCKAMSKLSLGIMELLGMSLGVGRNYFREFFKGNDSIIRLNYYPPCQKPELTLGTGPHCDPTSLTILHQDHVGGLEVFVDQKWYSIRPNQKAFVVNIGDTFMALSNGKYKSCLHRAVVNSKTPRKSVAFFLCPRGNKVIRPPIELGHPRVYPDFTWPLLLEFTQKHYRADTKTLDSFTKWLQKRSTEDERVK

SEQ ID NO: 818 - protein, 375 aa, Vitis vinifera
  misc_feature (1)..(375): Public GI ID no. 225431709
  misc_feature (222)..(318): Pfam Name: 2OG-FeII_Oxy Pfam Description: 2OG-Fe(II) oxygenase superfamily
  misc_feature (1)..(375): Bit score of 426.1 for HMM based on sequences of Figure 1
  misc_feature (1)..(375): Functional Homolog Of SEQ ID NO. 471
MASRTSTVVMAPPSEEKHDVGFLVFDPKKMAKQELPKQFIWPNEDLVEAKEELNEPLVDMEGFLKGDEVATAHAAELVRQACVTHGFFQVINHGVNPDILRATEVGLDPYFNLPMSRKLSMHKKVDELCGYCGAHSDRFAAKLTWKEMLTFEYHFKGDTDSEVADYFKNVVGEDFEETGWVFQRFCEAMKDLSLKIFKLLAISLNLEDTSYCEKFFEDGFAVLRCNYYPVCPESGLTFGTGPHCDPTSLTILHQDQVGGLEVFSNEKWYYVKPQPGALVINIGDTLMALTNGIYKSCLHRAAAKNDRDRISFAYFISPRQDKLVSPIKDLIAREGSKKYPDFKWEQLLDFTQVHDRTDDTTIKRFVEFLESSETK

SEQ ID NO: 819 - DNA, 1137 bp, Solanum lycopersicum
  misc_feature (1)..(1137): Ceres Annot ID no. 8461546
  misc_feature (1)..(1137): Encodes the peptide sequence at SEQ ID NO. 820
atgaccactaatagtataatcacaaaagaaaaatcacctatgcttggtgaggaaaaaccattgatttttgattcatcccatatgaaaaatgagttcaacattcctacacaatatatatggccagatgatgagaagccatgtgttgtagcacaagaacttcatgttcctcttattgacttaatgagtttcttttctggtgaccccgtcgcgacccaacaagcatctaggcttgttgatgaagcgtgcaggagtcatggtttctttcttgtagtaaatcacggagttgagtctaatctaatctccaatgcccatcgttacatggacacgttctttgacatgcctctctatgaaaaacaaaaagctcggagaaaaattggtgagcattgtggctacgccagcagctttactggaagattttcttcgaaacttccttggaaagagacactctctttacgatacaccgctaaagaaaactcatctcacataattaaagagtattttcaaaggacattgggtgaaagtttcaataatctcgggaatgtttatcaagaatattgcaattccatgaatacactttctcttaggatcatggaactcttaggaatcagcctgggtgtacaaaagagtcactttaaagagtttttcgaagacaatgattccataatgagactcaactactatcccccgtgcctgaaaccagagctcaccttaggaacagggccgcactatgatccaacatcattaaccgttctccatcaggattgtgttagtggatttcaggtttttgtggacaatgaatggtactccatcagtccaaatttcaatgcatttgtggttaacataggcgacacatttatggcactatcgaatggtatatacaaaagttgcttgcatagagcagttgttaacaacacaactcctaggaaatcactagctttctttctttgtccacacaaagataaggtggtgactccaccaactgaattggtggactacaacaaccctcgactatatcctgacttcacatggcctgctctccttgagtttactcaaaagcattatagagctgataaaaacactcttcaagctttctcaatgtggcttcaagaaaataatgcagaagctaaatatgagtaa

SEQ ID NO: 820 - protein, 378 aa, Solanum lycopersicum
  misc_feature (1)..(378): Ceres Annot ID no. 8461546
  misc_feature (219)..(317): Pfam Name: 2OG-FeII_Oxy Pfam Description: 2OG-Fe(II) oxygenase superfamily
  misc_feature (1)..(378): Bit score of 686.6 for HMM based on sequences of Figure 1
  misc_feature (1)..(378): Functional Homolog Of SEQ ID NO. 471
MTTNSIITKEKSPMLGEEKPLIFDSSHMKNEFNIPTQYIWPDDEKPCVVAQELHVPLIDLMSFFSGDPVATQQASRLVDEACRSHGFFLVVNHGVESNLISNAHRYMDTFFDMPLYEKQKARRKIGEHCGYASSFTGRFSSKLPWKETLSLRYTAKENSSHIIKEYFQRTLGESFNNLGNVYQEYCNSMNTLSLRIMELLGISLGVQKSHFKEFFEDNDSIMRLNYYPPCLKPELTLGTGPHYDPTSLTVLHQDCVSGFQVFVDNEWYSISPNFNAFVVNIGDTFMALSNGIYKSCLHRAVVNNTTPRKSLAFFLCPHKDKVVTPPTELVDYNNPRLYPDFTWPALLEFTQKHYRADKNTLQAFSMWLQENNAEAKYE

SEQ ID NO: 821 - protein, 380 aa, Ricinus communis
  misc_feature (1)..(380): Public GI ID no. 255573359
  misc_feature (223)..(320): Pfam Name: 2OG-FeII_Oxy Pfam Description: 2OG-Fe(II) oxygenase superfamily
  misc_feature (1)..(380): Bit score of 505.8 for HMM based on sequences of Figure 1
  misc_feature (1)..(380): Functional Homolog Of SEQ ID NO. 471
MELPASSLPPSPPMTTKVKPATRAFHFDPSFLKKQDDMPTQFIWAEGDLISATDELNEPLVDLNGFLKGDEEETARAAKLVRSACLKYGFFQVSNHGVDADLIRAAYQEIDTIFKLPFDKKLSIGKKPGSVYGYAFAHSDRFSSKLPWKETLSCGYHAEDTKPVVADYFKHVLGEDFERTGVIYQRYCEEMMKLSLVIFELLAISLGVDRFHYRKYFEDGGTSIMRCNYYPPCNNPSLTLGTGPHCDPTSLTILHQDDVGGLDVFADHKWRSVRPRPNALVINIGDTFMALTNGKYKSCLHRAVVNKESERRSIAFFVNPKEDKVVKPPEDDVACRELGERKYPDFTWSDLLKFTQNHYRSDDGTLQAFTHWFLSSKPSN

SEQ ID NO: 822 - protein, 368 aa, Selaginella moellendorffii
  misc_feature (1)..(368): Public GI ID no. 302759260
  misc_feature (218)..(315): Pfam Name: 2OG-FeII_Oxy Pfam Description: 2OG-Fe(II) oxygenase superfamily
  misc_feature (1)..(368): Bit score of 229.3 for HMM based on sequences of Figure 1
  misc_feature (1)..(368): Functional Homolog Of SEQ ID NO. 471
MVVKLPKHSKMAPTQGGTQGGVDYKLTTFLQGSLTLDDYVWSQEEWPKVAYNDYNDEDTVPIIDISLLRSEDAATRSKGLKDLMEAAREWGFFRLVNHGVLSDVTEKLESEGKELFALPLEQKKKAVRLPDSIIGYYFGAESVFSKAWLEAFHFSGDKEVTDNMIRQVSPENFNELSVHNYIDAYQKLAIEVVELMAIALGLEPSTFSKYTATKGDKSTVRVCYYPPCPQPQQTLGQRPHADPILITIVHQDDVGGLQILKNNRWIAVKPEPGTVVVNVGDTLQVLSNDIYPSVQHQVVLNSERSRLSMAFFLIPEADALIVPAKGLVDDEHPVRHPPFIYRDYRKSYGERRAVGKSHLESFYTLKDA

SEQ ID NO: 823 - protein, 318 aa, Arabidopsis lyrata
  misc_feature (1)..(318): Public GI ID no. 16118889
  misc_feature (168)..(266): Pfam Name: 2OG-FeII_Oxy Pfam Description: 2OG-Fe(II) oxygenase superfamily
  misc_feature (1)..(318): Bit score of 115.5 for HMM based on sequences of Figure 1
  misc_feature (1)..(318): Functional Homolog Of SEQ ID NO. 471
  misc_feature (98)..(98): Xaa is any aa, unknown, or other
MDSDFVPPISLKLPVIDFSNQTLKPGSSKWDEVKADVRKALEDYGCFEASFDKVSVELKTSVFEAMEELFELPIQTKQRNVSSKPFHGYICHNLYQSXGIDDANVLVKVNDFTQQLWPDHGNKSISETIHRFSDQLLELDVMVRRMIMESFGIEKYIDEHLKSTNYLFRMMKYTTPLDADVEETQVGLRAHTDKNIITILHQYQINGLEVKTKNENWIKVKPSQDSFVVMVGDSLCALLNGRLPSSYHRVMMMGNKTRYSTALFSAPKLETIIDSPEELVDEEHPRMFKPFDYNDFVHFFHTEAGRKAQSTLHAFAAF

SEQ ID NO: 824 - protein, 377 aa, Medicago truncatula
  misc_feature (1)..(377): Public GI ID no. 217072494
  misc_feature (224)..(321): Pfam Name: 2OG-FeII_Oxy Pfam Description: 2OG-Fe(II) oxygenase superfamily
  misc_feature (1)..(377): Bit score of 707.9 for HMM based on sequences of Figure 1
  misc_feature (1)..(377): Functional Homolog Of SEQ ID NO. 471
MAIECITSMPQQLLNQETKEQEKPLVFDASVLKHQVNLPTQFIWPDEEQACLNVPELHVPFIDLGGFLSGDPVAAMEASKVVGEACKKHGFFLVVNHGIDEKLISDAHAFMDDFFELPLSQKQRAQRKTGEHCGYASSFTGRFSSKLPWKETLSFQFSADEKSPNLVRDYLCNTMGNEFEEFGEVYQDYCKAMSNLSLGIMEILGMSLGVGKAHFREFFEENSSIMRLNYYPTCQKPELTLGTGPHCDPTSLTILHQDQVGGLQVYVDDQWHSISPHFNAFVVNIGDTFMALSNGRYKSCLHRAVVNSEKTRKSLAFFLCPLSDKVVTPPCELVDNYNPRIYPDFTWSMLLEFTQKHYRADIKTLEAFAKWVQCKST

SEQ ID NO: 825 - protein, 356 aa, Trichoderma reesei
  misc_feature (1)..(356): Public GI ID no. 340519930
  misc_feature (1)..(356): Trichoderma reesei QM6a
  misc_feature (173)..(284): Pfam Name: 2OG-FeII_Oxy Pfam Description: 2OG-Fe(II) oxygenase superfamily
  misc_feature (1)..(356): Bit score of 65.9 for HMM based on sequences of Figure 1
  misc_feature (1)..(356): Functional Homolog Of SEQ ID NO. 471
MAVPTLDFSKFISGTPEERKQFALDLLDSFERTGFAKLKNHTFSNDQLRELFHWGHSFFNQPLEVKNAIPNEPGPRPMRGYTPWRVEEVGKLHHEERVRIMKDSKEHFDQGPSDDVEFPNKWPTDSSLAGFRPFMEAFYQQCNDVCLTLMHALEVAWDIDDGSLVARCAPSATDMRLTHYPEIAVDELQTGRTTRIAPHTDFGPITLLFQDSTGGLEIEDRRANAFVPLPPTDTTEMILNVGDTLTRWTNGRITGGVHQVAVPEAMRGKSGLIIPSRMSMAYLFKAGRDTSVGPLPKFVSAKEPAIYPDITALEFQRWRNSIVYNLDKEEDSVKYNGHVDKPAAAAGLQQVQAIRA

SEQ ID NO: 826 - protein, 303 aa, Phytophthora infestans
  misc_feature (1)..(303): Public GI ID no. 301123381
  misc_feature (1)..(303): Phytophthora infestans T30-4
  misc_feature (160)..(244): Pfam Name: 2OG-FeII_Oxy Pfam Description: 2OG-Fe(II) oxygenase superfamily
  misc_feature (1)..(303): Bit score of 104.3 for HMM based on sequences of Figure 1
  misc_feature (1)..(303): Functional Homolog Of SEQ ID NO. 471
MAISKNTEVDAALQDPNHGELGKIIEEVRAAASEWGFFYVANHGLSEQEVGGFQTAMRAFFRLSKQIKRTIHRNTTNNRGYVEGELTKNKTDWKECFDFAGSGEDGPWLDETTLPGFRRKMRAYYDKMEHAACRLLKVFAVALGEEPAFSDQFFRSNTSSTMRLNYYPMAPEPEKTMGVYHHTDSGALTILLQDDEVASLQGTYTINIGDMMQVWSNDQFVAPLHRVVASKEAARFSAPFFYSPSYDVQVEPIVAKPGDVPNYRPISWCQFRLARFQGNYADLGKENQIGDYKIHGPIDFGNS

SEQ ID NO: 827 - protein, 385 aa, Populus tremula
  misc_feature (1)..(385): Public GI ID no. 53139652
  misc_feature (230)..(328): Pfam Name: 2OG-FeII_Oxy Pfam Description: 2OG-Fe(II) oxygenase superfamily
  misc_feature (1)..(385): Bit score of 731.6 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGEPCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 828 - protein, 380 aa, Selaginella moellendorffii
  misc_feature (1)..(380): Public GI ID no. 302790059
  misc_feature (227)..(323): Pfam Name: 2OG-FeII_Oxy Pfam Description: 2OG-Fe(II) oxygenase superfamily
  misc_feature (1)..(380): Bit score of 249.0 for HMM based on sequences of Figure 1
  misc_feature (1)..(380): Functional Homolog Of SEQ ID NO. 471
MAAAQTLQPASVPSVHNIPISGASTNVGSLAKALQGTETIPEVFLLPESERVTVPHDGYSEQVSLPVVDLRELLLPECSEESRKRIAREVAEASSEWGFFQVAGHGIPLELLERVRTQGRAFFSLPAEDKEKASLGLFQGYEGRHGFIPTRVPWSETFTLQIAPTSNVVPIVEKLWPDGNSELSSTIMDYGNELHSLGIKILELLAESLDLDQDFFSKNFKSKHSAGMRMNFYPPCPQPSMALGLGAHADPNCLTMLYQDEVGGLQIQKDDKWIAVKPDVDSLVLNIGDSLQAWSNGRFRSVQHRAVVNGNNARLSVAFFYSPDDSVSMEVPAQLVDEAHPLLYRPFTWAEYLQQIRTKRMRGKGGLDTFMKISDESKTD

SEQ ID NO: 829 - protein, 337 aa, Pseudomonas syringae
  misc_feature (1)..(337): Public GI ID no. 257484083
  misc_feature (1)..(337): Pseudomonas syringae pv. tabaci ATCC 11528
  misc_feature (185)..(291): Pfam Name: 2OG-FeII_Oxy Pfam Description: 2OG-Fe(II) oxygenase superfamily
  misc_feature (1)..(337): Bit score of 126.2 for HMM based on sequences of Figure 1
  misc_feature (1)..(337): Functional Homolog Of SEQ ID NO. 471
MTLHYVPIINLAPYFSGEPDGKAAVAQAVNQACKDIGFLVITEHQIPKELIDKVSGLTRQFFDLPLAEKRKVDRPSPEMVRGYSAIAEESLSYSLEESAPGDLKESFSIGPSNVPNEDYYHNAEAGSHFAPNVWPAEALLPGFKEAYQAYFEAMSELAQSLMRLFALALELDECFFDDRIDRHISMFRSLSYPDIKTEVEAGQLRASAHTDYGSLTIVRPDNALGGLQVRNQQGEWVDVPYVENGFVVNIGDLMMQWTNDQWISTLHRVVNPPISSEQDNRRQSLVFFHQPNYDTLIECLPGCLPPGTTPRHAPVTSGDHLMAKFVKQTTFGGSKVA

SEQ ID NO: 830 - protein, 392 aa, Malus x domestica
  misc_feature (1)..(392): Public GI ID no. 12231168
  misc_feature (236)..(333): Pfam Name: 2OG-FeII_Oxy Pfam Description: 2OG-Fe(II) oxygenase superfamily
  misc_feature (1)..(392): Bit score of 699.7 for HMM based on sequences of Figure 1
  misc_feature (1)..(392): Functional Homolog Of SEQ ID NO. 471
MAVECMIKPSSLQTMTQPPSPKTQQTQQHKEDDQKPLVFDASVFRYQTEIPSQFIWPDHEKPCKNTPELQVALIDLGGFLSGDKEAVAKASQLVGEACQKHGFFLIVNHGVDNKLIADAHCYMDDFFGMPLSEKQRAERKAGESCGYASSFTGRFSSKLPWKETLSFSYSAEKGSTNFIQDYFCDKMGEEFKEFGRVYQDYCKAMSTLSIGIMELLGLSLGVDRAYFKEFFEDNNSIMRLNYYPPCQRPEQTLGTGPHCDPTALTILHEDQVGGLEVFVDDQWHSVTPNLNAFVVNIGDTFMALSNGKYKSGLHRAVVNSETPRKSLAFFLCPRDDKVVKPPSGLVDTSSPRKYPDFTWSMLLEFTMKHYRADMKTLQVFSNWVQQKSNQKL

SEQ ID NO: 831 - protein, 268 aa, Oryza rufipogon
  misc_feature (1)..(268): Public GI ID no. 82568007
  misc_feature (227)..(268): Pfam Name: 2OG-FeII_Oxy Pfam Description: 2OG-Fe(II) oxygenase superfamily
  misc_feature (1)..(268): Bit score of 301.8 for HMM based on sequences of Figure 1
  misc_feature (1)..(268): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEV

SEQ ID NO: 832 - protein, 385 aa, Populus tremula
  misc_feature (1)..(385): Public GI ID no. 53139654
  misc_feature (230)..(328): Pfam Name: 2OG-FeII_Oxy Pfam Description: 2OG-Fe(II) oxygenase superfamily
  misc_feature (1)..(385): Bit score of 734.0 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 833 - protein, 359 aa, Dasypyrum villosum
  misc_feature (1)..(359): Public GI ID no. 255927117
  misc_feature (202)..(299): Pfam Name: 2OG-FeII_Oxy Pfam Description: 2OG-Fe(II) oxygenase superfamily
  misc_feature (1)..(359): Bit score of 688.0 for HMM based on sequences of Figure 1
  misc_feature (1)..(359): Functional Homolog Of SEQ ID NO. 471
MVQPVFDSAVLSGRADIPSQFIWPEGESPTPDAAEELHVPLIDIGGMLSGDPRAAAEVTRLVGEACERHGFFQVVNHGIDAELLADAHRCVDAFLTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSITRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDSTQKHYRADMKTLEVFSSWVVQQQQAAMT

SEQ ID NO: 834 - protein, 337 aa, Neosartorya fischeri
  misc_feature (1)..(337): Public GI ID no. 119501723
  misc_feature (1)..(337): Neosartorya fischeri NRRL 181
  misc_feature (183)..(280): Pfam Name: 2OG-FeII_Oxy Pfam Description: 2OG-Fe(II) oxygenase superfamily
  misc_feature (1)..(337): Bit score of 133.0 for HMM based on sequences of Figure 1
  misc_feature (1)..(337): Functional Homolog Of SEQ ID NO. 471
MTNPQPPPILDFSVFYGNDSQAKAQLVQRVRECCLNNGFFQITGHKVSPELQRRTFDCAKQFFDLPLAEKMKIERSPNAFNRGYEAFQSHMSQPGSAPDRKEGLFLGPDLPESHPYCVQRKLNCGPNRWPQGLDDLEEFKHISMEYYDAMFQLAKDIFAVLALTMDYDETFFDPLTEGAVATLRYLHYPPQPVREAEKGLGTGAHRDYSCITLLLQDGTGGLQVLDEPTGQWLDVEPVPGAYIVNLANVFSRMTNENYKSALHRVINKSGLERYSIPFFFTGNPDYVCECLSRFRKEGEPVKYPPATVHEVVGEAVRATVERAKRYNAERQGIHAEQ

SEQ ID NO: 835 - protein, 367 aa, Pyrenophora tritici-repentis
  misc_feature (1)..(367): Public GI ID no. 189206996
  misc_feature (1)..(367): Pyrenophora tritici-repentis Pt-1C-BFP
  misc_feature (220)..(322): Pfam Name: 2OG-FeII_Oxy Pfam Description: 2OG-Fe(II) oxygenase superfamily
  misc_feature (1)..(367): Bit score of 90.1 for HMM based on sequences of Figure 1
  misc_feature (1)..(367): Functional Homolog Of SEQ ID NO. 471
MAQPAHRSDQTTYDEARNGAAAYLQSRLAAKDNASDTNFIIPVIDLTRSFSESLADRRAVAAQIREACTTSGFFYITKHNVPKPACDGILKQAERFVHYLPLAKKEELHVEKSKFSLGWEPSEYTSIAGDKEKKEIFNFAYEAALDRTGGDGEYRELDGSAGESNVWPKEEDLPGFHAAIKEYYGAVLDLARHLFRLFALSLDLPDYFDPMTTHPGGNARLIYYPPPKISQPDSLAPTPEEQIGLGAHSDYQCFTLLLTSTTPGLEILKPSGQWHITSYIPNSLIVNVADFFMRWTNGLYKSTVHRVVNRSAEARYSVPFFFSVNYDTVIETLPTCLKDGEESKWKPIKAGEYILERVNATTAYGAI

SEQ ID NO: 836 - protein, 386 aa, Ipomoea nil
  misc_feature (1)..(386): Public GI ID no. 60498578
  misc_feature (226)..(324): Pfam Name: 2OG-FeII_Oxy Pfam Description: 2OG-Fe(II) oxygenase superfamily
  misc_feature (1)..(386): Bit score of 629.5 for HMM based on sequences of Figure 1
  misc_feature (1)..(386): Functional Homolog Of SEQ ID NO. 471
MAIECMIPTPTPNHERQEIENKPAAAVVFDSPVLRHESNIPTEFLWPDHEKPGPYAAREFQVPVIDMAAFRSGDPVAVAETCKLVDEACKKHGFFLVVNHGVDTELLSDGVREMDRYFELPLSFKEKALRKLGEHCGYASSFTGRFNAKLPWKETLSFRFSAEKECSHVVGEYFEKTLGQEFADLGELYQKYCNAMNTLALEITELLGMGLGVDRKHFSEFYQENDSVLRLNYYPPCQKPELTLGTGPHCDPTSLTILHQDSVSGLQVFVDNEWRAVNPTPNAFVVNIGDTFMALSNGLYKSCMHRAVVNNEIPRKSIAFFLCPHKDKVVTPPPELVDATHPKLYPDFKWPALLEYTQLHYRSDTDTLLNFATWLQQNQTLHATQA

SEQ ID NO: 837 - protein, 439 aa, Brassica oleracea
  misc_feature (1)..(439): Public GI ID no. 15422154
  misc_feature (300)..(385): Pfam Name: 2OG-FeII_Oxy Pfam Description: 2OG-Fe(II) oxygenase superfamily
  misc_feature (1)..(439): Bit score of 89.5 for HMM based on sequences of Figure 1
  misc_feature (1)..(439): Functional Homolog Of SEQ ID NO. 471
MGADTPQLPVIYLSDQTLKPGSEKWVEVRSDVRKALEDYGAFEVSYDRVSEELKKSVLDAMIELFELPVEAKQRNVSPKPYTGYSTHNGLSESLGIQDSNVLEKVNEFTQLLRPDCEGNKTMSETIQKFSEKLAELDVMVRRMVIESFGIENYFDEHLKSTNYRLRLMKYVAPPDVDANVAVSTKDSVDGANTNTTANADAGDIANGIAKVHIDDDANAKGDVCTGVGTNHNGDDVNTGDCANVKSNVDVGTNVSAKSSVGADVNIGTIADVKANTGTRTSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRPRSTLHAYCAVSGA

SEQ ID NO: 838 - protein, 439 aa, Brassica juncea
  misc_feature (1)..(439): Public GI ID no. 198286472
  misc_feature (300)..(384): Pfam Name: 2OG-FeII_Oxy Pfam Description: 2OG-Fe(II) oxygenase superfamily
  misc_feature (1)..(439): Bit score of 91.4 for HMM based on sequences of Figure 1
  misc_feature (1)..(439): Functional Homolog Of SEQ ID NO. 471
MGADTPQLPVIYLSDQTLKPGSEKWAEVRSGVRKALEEYGAFEVSYDRVTEELKKSVLDAMIELFELPVEAKQRNVSPKPYMGYSTHNGLSESLGIQDPNVLEKVNEFTQLLRPDCEGNKSMSETIQKFSEKLVELDVTVKRMVIQSFGIENYFDEHLKSLKNYRMRLMKYVAPPDVDAKDADDGANTNLNANADADAGAGDIANGIANVHIDEDVNAKGDVGTGGGDANHNGDDANTGDSASVKSNVDVGTDVNVKASVGADVNVGTIADANANIGTLSSANVGVGDSVKANGGADDEEKKLGLPSHTDKNLLTVLYQYEIDGLEVLTKDEKWIRLKPAHNSFVVIAGDSLYALMNGRLSRPFHRVRVTERKKTRYSIALFSAPDGDYIIEPPKELVDEKHPRLFKPFTYADLMSFYHTEAGRRSRSTLDAYSAVSGA

SEQ ID NO: 839 - protein, 359 aa, Dasypyrum villosum
  misc_feature (1)..(359): Public GI ID no. 255927113
  misc_feature (201)..(299): Pfam Name: 2OG-FeII_Oxy Pfam Description: 2OG-Fe(II) oxygenase superfamily
  misc_feature (1)..(359): Bit score of 690.6 for HMM based on sequences of Figure 1
  misc_feature (1)..(359): Functional Homolog Of SEQ ID NO. 471
MVQPVFDSAVLSGRADIPSQFIWPEGESPTPDAAEELHVPLIDIGGMLSGDPRAAAEVTRLVGEACERHGFFQVVNHGIDAELLADAHRCVDAFFTMPLPEKQRALRRPGESCGYASSFTGRFASKLPRKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTLKHYRADMKTLEVFSSWVVQQQQAAMT

SEQ ID NO: 840 - DNA, 1615 bp, Glycine max
  misc_feature (1)..(1615): Ceres Clone ID no. 1101515
  misc_feature (1)..(1615): Encodes the peptide sequence at SEQ ID NO. 841
aactagcagccttggcttttctttcatcctctctctcgaacttatttatctctctctgtttctctgttttgctctgcttctcaaaacataaccttttattattatagtattttactattataaactaattttgcattgctaatgcaatggccatagagtgcataacaaatatacaatcaatgtctcaaccacaaaagcaccaccaagagcacaaagaagatgaagcaccattggtttttgatgcctcacttctcaggcaccaactcaacctaccaaaacagttcatttggcctgatgaggaaaagccatgcatgaatgtgcctgagcttggtgtccctctcattgacttgggggggttcctctctggtgaccctgttgcaacaatggaggctgcaaggatagttggtgaggcatgccaaaagcatggtttctttcttgtggtgaaccatgggattgatgccaagttaatctctaatgctcatagctacatggatgacttctttgaggttcctctgtctcagaaacagagggctcagaggaaaacaggggaacactgtggttatgctagtagcttcactggcaggttctcttcaaagcttccatggaaagagacactttcttttcagtactcggctgaggaaaattcatccactattgtcaaagactacttgtgcaacacattggagaaagagtttgagcaatttgggagggtttaccaggactattgtgatgccatgagcaatctttctttggggataatggaacttttgggaatgagtcttggagttggtaaagcatgttttagagagttctttgaagagaataactcaataatgaggctcaattactaccctccttgtcaaaagcctgacctcactttgggcactggacctcactgtgacccaacatctttgaccattcttcaccaagaccaagtgggaggcctccaagtttttgttgacaatgagtggcattccattagcccaaatttcaatgcttttgttgtcaacataggtgacaccttcatggctctttcaaatggaaggtacaagagttgcttgcatagggcagtggtgaacagcaagaccacaagaaaatctcttgctttctttttgtgtccaaaaggtgataaggtggttagtccaccaagtgaattggtggatgatttgacaccaaggatataccctgattttacatggcctatgctgcttgagtttactcagaaacattatagagctgacatgaaaacccttgaggcattcaccaactggcttcttcaacggaaaatgagctgaaatgaaattttcaagcacatatgaatggcatattatctattagcctttgatagtctcctatgaatgaatagtgacaagtgtcaagtggaagaagtgtaattgatggcggagaaaagggcagcagcaaaaaggcactgagttggaaaaattgaaagaaaattcatgttttcttcatgaattgagtgttgcacgagtagtgattggagtagtattgaacaaaacaagggaaatgagataaaaatatttataaggcgtcaatgagaaaaaatcgccagctaatttttgtaatttttctttggtgatatagaaaagttattatt

SEQ ID NO: 841 - protein, 382 aa, Glycine max
  misc_feature (1)..(382): Ceres Clone ID no. 1101515
  misc_feature (228)..(325): Pfam Name: 2OG-FeII_Oxy Pfam Description: 2OG-Fe(II) oxygenase superfamily
  misc_feature (1)..(382): Bit score of 719.0 for HMM based on sequences of Figure 1
  misc_feature (1)..(382): Functional Homolog Of SEQ ID NO. 471
MAIECITNIQSMSQPQKHHQEHKEDEAPLVFDASLLRHQLNLPKQFIWPDEEKPCMNVPELGVPLIDLGGFLSGDPVATMEAARIVGEACQKHGFFLVVNHGIDAKLISNAHSYMDDFFEVPLSQKQRAQRKTGEHCGYASSFTGRFSSKLPWKETLSFQYSAEENSSTIVKDYLCNTLEKEFEQFGRVYQDYCDAMSNLSLGIMELLGMSLGVGKACFREFFEENNSIMRLNYYPPCQKPDLTLGTGPHCDPTSLTILHQDQVGGLQVFVDNEWHSISPNFNAFVVNIGDTFMALSNGRYKSCLHRAVVNSKTTRKSLAFFLCPKGDKVVSPPSELVDDLTPRIYPDFTWPMLLEFTQKHYRADMKTLEAFTNWLLQRKMS

SEQ ID NO: 842 - protein, 268 aa, Oryza rufipogon
  misc_feature (1)..(268): Public GI ID no. 208609488
  misc_feature (227)..(268): Pfam Name: 2OG-FeII_Oxy Pfam Description: 2OG-Fe(II) oxygenase superfamily
  misc_feature (1)..(268): Bit score of 301.3 for HMM based on sequences of Figure 1
  misc_feature (1)..(268): Functional Homolog Of SEQ ID NO. 471
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCQEMKELSLTIMELLELSLGVERGYYREFFADSSSIMRCNYYPPCPEPERTLGTGPHCDPTALTILLQDDVGGLEV

SEQ ID NO: 843 - protein, 317 aa, Phenylobacterium zucineum
  misc_feature (1)..(317): Public GI ID no. 197103783
  misc_feature (1)..(317): Phenylobacterium zucineum HLK1
  misc_feature (175)..(275): Pfam Name: 2OG-FeII_Oxy Pfam Description: 2OG-Fe(II) oxygenase superfamily
  misc_feature (1)..(317): Bit score of 85.9 for HMM based on sequences of Figure 1
  misc_feature (1)..(317): Functional Homolog Of SEQ ID NO. 471
MSQAAALPETIEPVSYALFDQDFEAFTRKLGDSFRRWGFAVICDHGLPQEKVDAAIGETKAFFALPEETKLKYKLPVAGQRGYTPFGVETAKGHQHYDLKEFWHVGRDLPPGHRFRSHMPDNVWPDAELPQFRQRVGWLYGALDAMGLKVLEAIATYVGLERRFFEPTVDFGNSILRLLHYPPVPKDGPHIRAGAHEDINVITLLLGAEEAGLEVKDHDGRWIPINPPPGALVINIGDMLQRLTNHRLPSTTHRVVNPAPERRGFPRYSTPFFLHFNSDYLIRTLPGCVDAAHPDRYPEPITADDYLQERLREIKLA

SEQ ID NO: 844 - protein, 385 aa, Populus tremula
  misc_feature (1)..(385): Public GI ID no. 53139600
  misc_feature (230)..(328): Pfam Name: 2OG-FeII_Oxy Pfam Description: 2OG-Fe(II) oxygenase superfamily
  misc_feature (1)..(385): Bit score of 733.3 for HMM based on sequences of Figure 1
  misc_feature (1)..(385): Functional Homolog Of SEQ ID NO. 471
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 845 - protein, 377 aa, Arabidopsis thaliana
  misc_feature (1)..(377): Public GI ID no. 1581592
  misc_feature (224)..(322): Pfam Name: 2OG-FeII_Oxy Pfam Description: 2OG-Fe(II) oxygenase superfamily
  misc_feature (1)..(377): Bit score of 675.8 for HMM based on sequences of Figure 1
  misc_feature (1)..(377): Functional Homolog Of SEQ ID NO. 471
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSERMRKSLAFFLCPKKDRVVTPPRELLDSITSRRYPDFTWSMFLEFTQKHYRADMNTLQAFSDWLTKPI

SEQ ID NO: 846 - protein, 324 aa, Brevundimonas subvibrioides
  misc_feature (1)..(324): Public GI ID no. 302381882
  misc_feature (1)..(324): Brevundimonas subvibrioides ATCC 15264
  misc_feature (180)..(281): Pfam Name: 2OG-FeII_Oxy Pfam Description: 2OG-Fe(II) oxygenase superfamily
  misc_feature (1)..(324): Bit score of 74.9 for HMM based on sequences of Figure 1
  misc_feature (1)..(324): Functional Homolog Of SEQ ID NO. 471
MTATLDHPTSTLTDRGITPVSMSRYDTDFQGFSDDLGASFKRYGFAVVSDHGLDEQVIEAAIADAKAFFALPEAVKRAYHQPGTGGARGLTPFGTEAAKDAKAVDLKEFWHTGRELPAGHAYGQYMRANLWPTEVPGFRDHLYGMFEALDALGRRILRAIARYMDLGDDYFEDKVELGNSVLRMLHYPPVPADAPGVRAGAHEDINVITLLLGAEEAGLQLKDADGEWLDIAPPPGALVVNIGDMLQRLTNHVLPSTTHRVVNPAPERRGFARYSTPFFLHFNPDFVIETLPSTITDANPDRYAGQSIMAEDFLTQRLKEIRLL

SEQ ID NO: 847 - protein, 439 aa, Brassica juncea
  misc_feature (1)..(439): Public GI ID no. 198286480
  misc_feature (300)..(385): Pfam Name: 2OG-FeII_Oxy Pfam Description: 2OG-Fe(II) oxygenase superfamily
  misc_feature (1)..(439): Bit score of 90.0 for HMM based on sequences of Figure 1
  misc_feature (1)..(439): Functional Homolog Of SEQ ID NO. 471
MGADTPQLPVIYLSDQTLKPGSEKWVEVRSDVRKALEDYGGFEVSYDRVSEELKKSVLDAMIELFELPVEAKQRNVSPKPYTGYSTHNGLSESLGIQDSNVLEKVNEFTQLLRPDCEGNKTMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDVCTGAGTNHNGDDVNTGDCANVKSNVDVGTNVSAKSSVGADVNTGTIDDVNANAGTRSSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRARSTLHAYCAVSGA

SEQ ID NO: 848 - DNA, 1158 bp, Populus trichocarpa
  misc_feature (1)..(1158): Ceres Annot ID no. 1522333
  misc_feature (1)..(1158): Encodes the peptide sequence at SEQ ID NO. 849
atggcaatagattgcatcaaaaccatgccttcaaaaaccacccatcatcaccatccaaaagatcaagatcaatgcaaagatgataacaagtctttagtgtttgatgcacaagttcttagataccaatcaagcatacctcaacagttcatttggcctgaccatgaaaagcctagtgctaatgcacctaaactccaagttccacttatagacttgggtgatttcctctctggtaaccctgatgctgcaatggaagcttcaagacttgttggtgaagcatgtcaaaaacatggtttctttcttgttgttaatcatggagttgataagacactcattgctcatgctcttaattacatggacaacttctttgaattgcctctttctgagaaacaaaaggctcaaagaaaaattggcgagtcttgtggatatgctagtagctttactggcaggttttcctccaaacttccatggaaagaaacactttcttttagctatacagctgagaagaattcatcaaaacatattgagcaatattttcatgacagaatgggggaagacttcgccaaattcggaagggtgtaccaggattactgcgaggccatgagcactttgtcactagggatcatggagctattaggaatgagccttggtgtgagcagagcacatttcagagaatatttcgaagagaatgattcaataatgaggcttaactactaccctccatgccaaaagcctgaacttactttaggaactggtcctcattgtgatccaacttctttaaccatccttcatcaagaccaagtgggtggtcttcaagtgtatgtagacaacgaatggtgttcgattagccccaatttcgacgcttttgtcgttaacattggcgacaccttcatggctctatcaaatggtagatacaagagttgtttgcaccgagcggtggtgaacagccaaacgccaagaaaatctcttgctttcttcttgtgtccaaggaatgacaagaaggtaactccaccaaaggaattagtggacacatgcaatccaagaatatatccagatttcacatggcctatgttgcttgaattcacacaaaagcattacagagctgacatgaagacacttgagatgttcacaaattggcttcaacaaagaaatgttagctga

SEQ ID NO: 849 - protein, 377 aa, Populus trichocarpa
  misc_feature (1)..(377): Ceres Annot ID no. 1522333
  misc_feature (222)..(320): Pfam Name: 2OG-FeII_Oxy Pfam Description: 2OG-Fe(II) oxygenase superfamily
  misc_feature (1)..(377): Bit score of 719.9 for HMM based on sequences of Figure 1
  misc_feature (1)..(377): Functional Homolog Of SEQ ID NO. 471
MPSKTTHHHHPKDQDQCKDDNKSLVFDAQVLRYQSSIPQQFIWPDHEKPSANAPKLQVPLIDLGDFLSGNPDAAMEASRLVGEACQKHGFFLVVNHGVDKTLIAHALNYMDNFFELPLSEKQKAQRKIGESCGYASSFTGRFSSKLPWKETLSFSYTAEKNSSKHIEQYFHDRMGEDFAKFGRVYQDYCEAMSTLSLGIMELLGMSLGVSRAHFREYFEENDSIMRLNYYPPCQKPELTLGTGPHCDPTSLTILHQDQVGGLQVYVDNEWCSISPNFDAFVVNIGDTFMALSNGRYKSCLHRAVVNSQTPRKSLAFFLCPRNDKKVTPPKELVDTCNPRIYPDFTWPMLLEFTQKHYRADMKTLEMFTNWLQQRNVS

SEQ ID NO: 850 - protein, 337 aa, Vitis vinifera
  misc_feature (1)..(337): Public GI ID no. 225465379
  misc_feature (1)..(337): Bit score of 231.2 for HMM based on sequences of FIGURE 1.
  misc_feature (189)..(288): Pfam Name: 2OG-FeII_Oxy Pfam Description: 2OG-Fe(II) oxygenase superfamily
  misc_feature (1)..(337): Functional Homolog Of SEQ ID NO. 471
MDSKVLSTGIPFTTLPENYIRPESERPRLSEIADCENVPIIDLSCDDRAQIIEQLADACSRYGFFQVINHGVSAEAIEKMLHVANEFFQLPVEEKMKLYSDDPSKTMRLSTSFNVKKEKVHNWRDYLRLHCHPLEQYMPEWPSNPPEFKDTVSNYCVEVRQLGHRLEEAIGESLGLEKDYIRNTLGEQGQHMAVNYYPPCPEPELTYGLPAHTDPNALTILLQDSHVAGLQVLKDGKWVAVKPHPGAFVVNIGDQLQALSNGKYRSVWHRATVNVGKARMSIASFLCPSDDALISPARALTDEGSAAIYRSFTYAEYYKKFWSRNLDQEHCLEVFKN

SEQ ID NO: 851 - protein, 336 aa, Brachypodium distachyon
  misc_feature (1)..(336): Public GI ID no. 357114308
  misc_feature (1)..(336): Bit score of 224.9 for HMM based on sequences of FIGURE 1.
  misc_feature (188)..(287): Pfam Name: 2OG-FeII_Oxy Pfam Description: 2OG-Fe(II) oxygenase superfamily
  misc_feature (1)..(336): Functional Homolog Of SEQ ID NO. 471
MAEQLISTCAHETLPESYVRDAAERPRLDEVVPDAHIPVVDLAHPDRAAIVSQIGAACRSHGFFQVLNHGLPAELMEAAMAVAHEFFRLSPEEKAKLYSDDPAKKIRLSTSFNVRKETVHNWRDYLRLHCHPLEQFVPDWPSNPSAFREVMSTYCKEIRELGFRLYAAISESLGLEEDYMKKVLGEQEQHMAVNFYPKCPSPELTYGLPAHTDPNALTILLMDEQVAGLQVLKDGQWIAVNPRPNALVVNLGDQLQALSNGRYKSVWHRAVVNSDRPRMSIASFMCPCNSVVLGPAEKLVGDASPAVYRNYTYDEYYKKFWSRNLDQEHCLELFRT

SEQ ID NO: 852 - protein, 351 aa, Sorghum bicolor
  misc_feature (1)..(351): Public GI ID no. 242076892
  misc_feature (1)..(351): Bit score of 215.9 for HMM based on sequences of FIGURE 1.
  misc_feature (199)..(297): Pfam Name: 2OG-FeII_Oxy Pfam Description: 2OG-Fe(II) oxygenase superfamily
  misc_feature (1)..(351): Functional Homolog Of SEQ ID NO. 471
MAPAISKPLLSDLVAQIGKVPSSHIRPVGDRPDLANVDNESGAGIPLIDLKMLNGPERRKVVEAIGRACESDGFFMVTNHGIPAAVVEGMLRVAREFFHLPESERLKCYSDDPKKAIRLSTSFNVRTEKVNNWRDFLRLHCYPLESFVDQWPSNPPSFRQVVGTYATEARALALRLLEAISESLGLERSHMVRAMGRHAQHMAVNYYPPCPQPELTYGLPGHKDPNAITLLLQDGVSGLQVQRGGRWVAVNPVPDALVINIGDQMQALSNDRYKSVLHRVIVNSESERISVPTFYCPSPDGVIAPADALVDDAHPLAYRPFTYQEYYDEFWNMGLQSASCLDRFRPGGSIE

SEQ ID NO: 853 - protein, 344 aa, Ricinus communis
  misc_feature (1)..(344): Public GI ID no. 255548069
  misc_feature (1)..(344): Bit score of 221.1 for HMM based on sequences of FIGURE 1.
  misc_feature (197)..(295): Pfam Name: 2OG-FeII_Oxy Pfam Description: 2OG-Fe(II) oxygenase superfamily
  misc_feature (1)..(344): Functional Homolog Of SEQ ID NO. 471
MAIAKPLLSDLVSTITSVPSNFIRPLSDRPNFNEVIQTSDCSIPLIDLQGLDGPLRSTLVKEIGQACQGYGFFQVKNHGIPEDVIDKMLSVSREFFHLPESERMKNYSDDPMMRTRLSTSFNVRTEKTSNWRDFLRLHCYPLDDYMQEWPTNPPSFREDVGEYCRNVRDLAVRLLEAISESLGLERDYINKALDKHAQHLAVNYYPSCPQPELTYGLPVHADPNVITILLQDDVPGLQVLKDGKWVAVSPVPHTFIVNIGDQIQVISNDRYKSVLHRAVVNSNKERISIPTFYCPSPDAAIGPAPPLVDNHHPLLYTNFTYSQYYHKFWNRGLATHTCLDMFKK

SEQ ID NO: 854 - protein, 343 aa, Glycine max
  misc_feature (1)..(343): Public GI ID no. 356521217
  misc_feature (1)..(343): Bit score of 221.3 for HMM based on sequences of FIGURE 1.
  misc_feature (189)..(288): Pfam Name: 2OG-FeII_Oxy Pfam Description: 2OG-Fe(II) oxygenase superfamily
  misc_feature (1)..(343): Functional Homolog Of SEQ ID NO. 471
MGDIDPAFIQSTEHRPKAKVVEVCEIPVIDLSEGRKELLISQIGKACEEWGFFQVINHGVPFEISREVEIEAKKFFEMSLEEKKKLKRDEFNAMGYHDGEHTKNVRDWKEVFDYLVENTAEVPSSHEPNDMDLRILTNQWPQNSPRFRETLQEYAREVEKLAYKLLELISLSLGLDAEKFHGCFMNQLSMVRLNYYPTCPFPDLALGVGRHKDSSALTVLAQDDVGGLQVKRKSDGEWIPVKPTPNAFIINVGDIVQVWSNDKYESVEHRVVVNTERERFSIPFFFSPAHYVIVKPAEELVNEQNPARYREYNYGKFFANRNRSDFKKRDVENIQIYHFRILD

SEQ ID NO: 855 - protein, 347 aa, Vitis vinifera
  misc_feature (1)..(347): Public GI ID no. 147865705
  misc_feature (1)..(347): Bit score of 211.7 for HMM based on sequences of FIGURE 1.
  misc_feature (193)..(291): Pfam Name: 2OG-FeII_Oxy Pfam Description: 2OG-Fe(II) oxygenase superfamily
  misc_feature (1)..(347): Functional Homolog Of SEQ ID NO. 471
  misc_feature (14)..(14): Xaa is any aa, unknown, or other
  misc_feature (185)..(185): Xaa is any aa, unknown, or other
  misc_feature (204)..(204): Xaa is any aa, unknown, or other
  misc_feature (240)..(240): Xaa is any aa, unknown, or other
MGEIDPAFIQSIEXRPKLTVTDPGEIPVIDLSALDSGAVDLLVADIGKACEEWGFFKVINHGVPLEVVRRIEAAMKEFFDQSIDEKRKVKRDEAKPMGYHDSEHTKNVRDWKEVLDIAVEDPLVISASPDPQDQELTKYYNQWPEYPPEFRKILKEYAGEIEKLAFKLLELISLSLGLAGDRLIXFFQGQTSFIRLNHYPPCPXPELALGVGRHKDAGALTVLFQDGVGGLEVKRKADGXWVGVKPIPNAYIINVGDIIQVWSNDKYESVEHRVVANSEKERFSIPFFLFPAHHVNVKPLEELTNEENPPKFKEYNWGKFMATRNRSDFKKQAVENIQIHHFRVSEQ

SEQ ID NO: 856 - protein, 337 aa, Solanum lycopersicum
  misc_feature (1)..(337): Public GI ID no. 350540006
  misc_feature (1)..(337): Bit score of 226.4 for HMM based on sequences of FIGURE 1.
  misc_feature (190)..(288): Pfam Name: 2OG-FeII_Oxy Pfam Description: 2OG-Fe(II) oxygenase superfamily
  misc_feature (1)..(337): Functional Homolog Of SEQ ID NO. 471
METKVISSGINHSTLPQSYIRPESDRPRLSEVVDCENVPIIDLSCGDQAQIIRQIGEACQTYGFFQVINHGVPKEVVEKMLGVAGEFFNLPVEEKLKLYSDDPSKTMRLSTSFNVKKETVHNWRDYLRLHCYPLEKYAPEWPSNPSSFREIVSRYCREIRQLGFRLEEAIAESLGLDKECIKDVLGEQGQHMAINYYLPCPQPELTYGLPAHTDPNSLTILLQDLQVAGLQVLKDGKWLAVKPQPDAFVINLGDQLQAVSNGKYRSVWHRAIVNSDQARMSVASFLCPCDSAKISAPKLLTEDGSPVIYQDFTYAEYYNKFWSRNLDQQHCLELFKN

SEQ ID NO: 857 - protein, 336 aa, Hordeum vulgare subsp. vulgare
  misc_feature (1)..(336): Public GI ID no. 326491817
  misc_feature (1)..(336): Bit score of 213.4 for HMM based on sequences of FIGURE 1.
  misc_feature (188)..(287): Pfam Name: 2OG-FeII_Oxy Pfam Description: 2OG-Fe(II) oxygenase superfamily
  misc_feature (1)..(336): Functional Homolog Of SEQ ID NO. 471
MAEQLISTAVHHTLPHSYVRSEAERPRLHEVVPDADIPVVDLANPDRAAVVSQIGAACSSHGFFQVLNHGLPVEAMRAAMAVAHDFFRLPPEEKAKLYSDDPAKKMRLSTSFNVRKETVHNWRDYLRLHCHPLDQFVPEWPANPPPFRDVMSTYCKEVRDLGFRLYAAISESLGLEQDYIKKVLGEQEQHMAVNFYPKCPSPELTYGLPAHTDPNALTILMMDEQVAGLQVLKEGRWIAVNPRPNALVINLGDQLQALSNGRYRSVWHRAVVNSDRPRMSIASFLCPCNSVMLGPAEKLIGAETPAVYRNYTYDEYYKKFWSRNLDQEHCLELFRT

SEQ ID NO: 858 - protein, 348 aa, Vitis vinifera
  misc_feature (1)..(348): Public GI ID no. 225426514
  misc_feature (1)..(348): Bit score of 227.3 for HMM based on sequences of FIGURE 1.
  misc_feature (199)..(296): Pfam Name: 2OG-FeII_Oxy Pfam Description: 2OG-Fe(II) oxygenase superfamily
  misc_feature (1)..(348): Functional Homolog Of SEQ ID NO. 471
MVPSTTKLLLTDMVLGVDHVPSNYVRPPSERPNFKDVQASDVSIPLIDLQDLQGPGRPDVVKQIGQACQHSGFFQIQNHGVSETMISNILRLARDFFQLPESERLKNYSDNPSNPVRLSTSFNVKTEKVANWRDFLRLHCYPLEDYVHQWPSNPPSFREDVAEYCTSIRALVLRLLETISESLGLEKNYVSGVLGKHGQHMAMNYYPPCPQPELTYGLPGHTDCSLITVLLQDDVPGLQVLRNGKWVSVNPIPNSFIVNIGDHMQVISNDRYKSVLHRAVVNCNKDRISIPTFYCPSPDAVIGPSPELVDDDHPAVYRNFTCEEYYTQFWNRGLATESCLDTFKASTT

SEQ ID NO: 859 - protein, 344 aa, Vitis vinifera
  misc_feature (1)..(344): Public GI ID no. 225453648
  misc_feature (1)..(344): Bit score of 227.9 for HMM based on sequences of FIGURE 1.
  misc_feature (198)..(295): Pfam Name: 2OG-FeII_Oxy Pfam Description: 2OG-Fe(II) oxygenase superfamily
  misc_feature (1)..(344): Functional Homolog Of SEQ ID NO. 471
MANAKLLLSDLASSIDCVPSRYVRPVNDRPNLDEVQSSLDGSIPLIDLQDLHGPSRSHVIKQIAEACQIDGFFRVKNHGIPESVIHGMLSITKEFFHLPESERLKNYSDDPLKTMRLSTSFNVKTEQVSNWRDFLRLYCYPLEDYIQEWPSNPPSFREVVAEYCKEARKLALLLLEAISESLGLERNHIDKALGKHSQQMALNYYPPCPQPELTFGLPGHADPNALTILLQDDVPGLQVLKDGKWVAIHPIPNTFIVNIGDQIQVLSNDCYKSAVHRAVVNCQKERISIPTFYCPSPDAVIGPAPGLVDHGHPALYRKFTYSEYFGKFWNRGLATQSCLDMFKT

SEQ ID NO: 860 - protein, 336 aa, Zea mays
  misc_feature (1)..(336): Public GI ID no. 226498686
  misc_feature (1)..(336): Bit score of 212.9 for HMM based on sequences of FIGURE 1.
  misc_feature (45)..(73): Pfam Name: 2OG-FeII_Oxy Pfam Description: 2OG-Fe(II) oxygenase superfamily
  misc_feature (1)..(336): Functional Homolog Of SEQ ID NO. 471
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDKYYAKFWSRNLDQEHCLELFRT

SEQ ID NO: 861 - protein, 349 aa, Hordeum vulgare subsp. vulgare
  misc_feature (1)..(349): Public GI ID no. 326494732
  misc_feature (1)..(349): Bit score of 202.8 for HMM based on sequences of FIGURE 1.
  misc_feature (200)..(298): Pfam Name: 2OG-FeII_Oxy Pfam Description: 2OG-Fe(II) oxygenase superfamily
  misc_feature (1)..(349): Functional Homolog Of SEQ ID NO. 471
MAPAIAAKPLLSDLVAQTRRVPSSHIRAVGDRPDLANVDHESGAGIPLIDLKHLDGPGRRRVVEAIGSACENDGFFMVTNHGIPEAVVDGMLRVAREFFHLPESERLKCYSDDPKKAIRLSTSFNVRTEKVSNWRDFLRLHCYPLESFIDQWPSNPPAFREAVGTYSTEARALALRLLEAISESLGLERGHMVKAMGRHAQHMAVNYYPPCPQPELTYGLPGHKDPNAVTLLLQDGVSGLQVRRDGRWVAVNPVPGALVINIGDQLQALSNDRYKSVLHRVIVNSESERISVPTFYCPSPDAVVAPAEALVDGGHRLAYRPFTYQEYYEEFWNMGLEAASCLDRFRPIA

SEQ ID NO: 862 - protein, 352 aa, Oryza sativa Indica Group
  misc_feature (1)..(352): Public GI ID no. 116311010
  misc_feature (1)..(352): Bit score of 208.5 for HMM based on sequences of FIGURE 1.
  misc_feature (199)..(297): Pfam Name: 2OG-FeII_Oxy Pfam Description: 2OG-Fe(II) oxygenase superfamily
  misc_feature (1)..(352): Functional Homolog Of SEQ ID NO. 471
MAPAIAKPLLSDLVAQSGQVPSSHIRPVGDRPDLDNVDHESGAGIPVIDLKQLDGPDRRKVVEAIGSACETDGFFMVKNHGIPEEVVEGMLRVAREFFHMPESERLKCYSDDPKKAIRLSTSFNVRTEKVSNWRDFLRLHCYPLESFIDQWPSNPPSFRQVVGTYSREARALALRLLEAISESLGLERGHMVSAMGRQAQHMAVNYYPPCPQPELTYGLPGHKDPNAITLLLQDGVSGLQVQRNGRWVAVNPVPDALVINIGDQIQALSNDRYKSVLHRVIVNSESERISVPTFYCPSPDAVIAPAGALVDGALHPLAYRPFTYQAYYDEFWNMGLQSASCLDRFRPNDQAV

SEQ ID NO: 863 - protein, 340 aa, Oryza sativa Japonica Group
  misc_feature (1)..(340): Public GI ID no. 115460102
  misc_feature (1)..(340): Bit score of 212.2 for HMM based on sequences of FIGURE 1.
  misc_feature (190)..(290): Pfam Name: 2OG-FeII_Oxy Pfam Description: 2OG-Fe(II) oxygenase superfamily
  misc_feature (1)..(340): Functional Homolog Of SEQ ID NO. 471
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNPVQERMSVASFMCPCNSAVISPARKLVADGDAPVYRSFTYDEYYKKFWSRNLDQEHCLELFKGQ

SEQ ID NO: 864 - protein, 336 aa, Sorghum bicolor
  misc_feature (1)..(336): Public GI ID no. 242040385
  misc_feature (1)..(336): Bit score of 212.0 for HMM based on sequences of FIGURE 1.
  misc_feature (45)..(74): Pfam Name: 2OG-FeII_Oxy Pfam Description: 2OG-Fe(II) oxygenase superfamily
  misc_feature (1)..(336): Functional Homolog Of SEQ ID NO. 471
MAEQLLSTAVHDTLPGSYVRPESQRPRLAEVVTGARIPVVDLGSPDRAAVVAAIGDACRSHGFFQVLNHGVHADLVAAVMAVGRAFFRLSPEEKAKLYSDDPARKIRLSTSFNVRKETVHNWRDYLRLHCHPLDEFVPDWPSNPPDFKDTMSTYCKEVRELGFRLYAAISESLGLEASYMKETLGEQEQHMAVNFYPPCPEPELTYGLPAHTDPNALTILLMDQDVAGLQVLHGGKWVAVNPQPGALIINIGDQLQALSNGQYRSVWHRAVVNSDRERMSVASFLCPCNHVVLGPAKKLVTEDTPAVYRSYTYDEYYKKFWSRNLDQEHCLELFRT

SEQ ID NO: 865 - protein, 361 aa, Picea sitchensis
  misc_feature (1)..(361): Public GI ID no. 116783156
  misc_feature (1)..(361): Bit score of 212.4 for HMM based on sequences of FIGURE 1.
  misc_feature (213)..(301): Pfam Name: 2OG-FeII_Oxy Pfam Description: 2OG-Fe(II) oxygenase superfamily
  misc_feature (1)..(361): Functional Homolog Of SEQ ID NO. 471
MATAVLESTKNVDGYDYMKGVKHLVDSGALNSVPIKYVFPQDSRPSAAEIAEGESIPIIDLSAMDKSPEERLEAIKYLGQACAHWGFFQVVNHGIQESLITSMLEAAHQFFSLSSQEKLKYESTDVLNPVRYGTSFNAKVDQFFNWRDYLKHFSYPQLHTPDNPPNYREVAGEYFKETRKLALRLMGAISESLGLKSDYIQTVFKDGIQIGVLNFYPQCPEPDETMGIAPHSDHGGLTILLQNDVGGLQVRHEGRWVAVEPSPNAFVVNVSDHLEIVSNGRYKSVEHRAVVNAERARISIAAPNGPAMDAPIFPAPQLVDETHPPLYKSMLYGEYLRRQQSTGLRGKGNLESVKIATDGKR

SEQ ID NO: 866 - protein, 341 aa, Arabidopsis lyrata subsp. lyrata
  misc_feature (1)..(341): Public GI ID no. 297808467
  misc_feature (1)..(341): Bit score of 220.6 for HMM based on sequences of FIGURE 1.
  misc_feature (189)..(288): Pfam Name: 2OG-FeII_Oxy Pfam Description: 2OG-Fe(II) oxygenase superfamily
  misc_feature (1)..(341): Functional Homolog Of SEQ ID NO. 471
MAATLISTGLRHTTLPENYVRPISDRPRLSEVSQLEDFPLIDISSTDRSVLVQQIHQACARFGFFQVINHGVSKQLIDEMVSVAHEFFSMSMEEKMKLYSDDPTKTTRLSTSFNVKKEEVNNWRDYLRLHCYPIHKYVHEWPSNPPSFKEIVSKYSREVREVGFKIEELISESLGLEKDYMKKVLGEQGQHMAVNYYPPCPEPELTYGLPAHTDPNALTILLQDTTVCGLQILIDGQWFAVNPHPDAFVINIGDQLQALSNGVYKSVWHRAVTNTENPRLSVASFLCPADCAVMSPAKPLWEAEDNETKPVYRDFTYAEYYKKFWSRNLDQEHCLEYFRNN

SEQ ID NO: 867 - protein, 370 aa, Picea sitchensis
  misc_feature (1)..(370): Public GI ID no. 116791020
  misc_feature (1)..(370): Bit score of 234.2 for HMM based on sequences of FIGURE 1.
  misc_feature (215)..(312): Pfam Name: 2OG-FeII_Oxy Pfam Description: 2OG-Fe(II) oxygenase superfamily
  misc_feature (1)..(370): Functional Homolog Of SEQ ID NO. 471
MEVSEIGLESKSQAFLNVDQAFILSPENRPNTKHSDFTRDRIPLIDLSILNSTTPPHPTSLASLVTQIHAACRDWGFFQVINHGVSLHLLHTLQSETARFFSLPMQEKTKVRRDFDHPLGYYDTELTKNIRDWKEVFDFACRGIIRLPSNLEIDSNETQTLTNQWPENPPRLREACEKYAEAVEKLSFILLELISLSLGLPAEYFNSKFEDHTSFLRLNHYPPCPVPELALGVGQHKDAGALTVLVQDEVGGLQVRRKDGEWIGVKPVPDSFVINVGDCIQVWSNDKYESVEHRVVVNDKKERFSIPFFLNPSHYAMVRPALELVNEENPIKYKEYNWGKFLKSRYESNFKHLGIENLQIHHFSISPNSS

SEQ ID NO: 868 - protein, 363 aa, Selaginella moellendorffii
  misc_feature (1)..(363): Public GI ID no. 302769898
  misc_feature (1)..(363): Bit score of 210.1 for HMM based on sequences of FIGURE 1.
  misc_feature (219)..(312): Pfam Name: 2OG-FeII_Oxy Pfam Description: 2OG-Fe(II) oxygenase superfamily
  misc_feature (1)..(363): Functional Homolog Of SEQ ID NO. 471
MCIHNKDQCYLKPKRYHRKTMEILPLHLGVKHLLDSGLHKVPGIYIRSKEERPNVVHREESFPVLDLGAALNSSEARAALVPQIREACMKWGFFQVINHGVPHSLVDEMQSVAREFHALPNEEKMRYFSTDTESRMRYGTSFNVAQDKVFSWRDYLRHSCLPLAEMQDLWPEKPASYRKVTADYSTRVRNLAKFLLELISESLDLPKDYIDKAFNGCSQIMALNFYPACPEPDLVLGIGPHSDPGSITLLLQDHVEGLQVMHGNEWYSVKPIPYSFVVNLGDQIQILSNDKYKSAEHRAVVNSSEDRMSIPISMGPNWESLVHPASKLVEGSPVFKPMFYKDYIMALQAGGLNRQWLLDTLRT

SEQ ID NO: 869 - protein, 366 aa, Picea sitchensis
  misc_feature (1)..(366): Public GI ID no. 116793430
  misc_feature (1)..(366): Bit score of 226.6 for HMM based on sequences of FIGURE 1.
  misc_feature (73)..(87): Pfam Name: 2OG-FeII_Oxy Pfam Description: 2OG-Fe(II) oxygenase superfamily
  misc_feature (1)..(366): Functional Homolog Of SEQ ID NO. 471
MALQSESQACLGIDAAFILSPEHRPNAKQCEFTLDQIPLIDLSPLNPTSPPQPTTLDSLVAEIHAACRDWGFFQVINHGVSPHLLHTIRSEAANFFSLPMQEKTKVRRDFDDRLGYYDTELTKNVRDWKEVFDFACRGTIRLPSSFELESDETRTLINQWPQNPPCLREACEKYAEAVEKFSFRLLELISRSLGLPADYFNSKFEEHTSVLRLNHYSPCPVPELALGVGRHKDPGALTVLAQDEVGGLQVKRKDGEWIGVKPIPGAFVINVGDCMQVWSNDKYESVEHRVVVNDKKERFSVPFFFNPSHYVMVGPVSDLVNEKNPSRYKEFSWGKFVKRRRDGNFKNLGTENLQIHHFYISQNSSE

SEQ ID NO: 870 - protein, 349 aa, Arabidopsis thaliana
  misc_feature (1)..(349): Public GI ID no. 18402081
  misc_feature (1)..(349): Bit score of 212.7 for HMM based on sequences of FIGURE 1.
  misc_feature (47)..(73): Pfam Name: 2OG-FeII_Oxy Pfam Description: 2OG-Fe(II) oxygenase superfamily
  misc_feature (1)..(349): Functional Homolog Of SEQ ID NO. 471
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEIWTNDKYWSAEHRVVVNTTRERYSIPFFLLPSHDVEVKPLEELVSPENPPKYKGYKWGKFYVSRNRSDFRKLEIENIQIDDFKVKT

SEQ ID NO: 871 - protein, 368 aa, Picea sitchensis
  misc_feature (1)..(368): Public GI ID no. 116792100
  misc_feature (1)..(368): Bit score of 202.1 for HMM based on sequences of FIGURE 1.
  misc_feature (219)..(315): Pfam Name: 2OG-FeII_Oxy Pfam Description: 2OG-Fe(II) oxygenase superfamily
  misc_feature (1)..(368): Functional Homolog Of SEQ ID NO. 471
MASTALPPTSLNPYQQTHEEKEQQYPVHYRGVKDLVDNGSRTLPQIYVRPPDERLVINSHQQQIPLIDLSELEGAGRSATVEAIGRACRDWGFFLVKNHGVSESTMENEMRVGREFFHLPTEEKMRYFSTDHKSRMRYATSFNVKEDKTLNWRDFLRYSFKPLEEMVPLWPDKPTDFRKENAEYIRKIGDLASILLSAISESLGLPSEYINEVYGDYSQYMAYNFYPACPNPEQTLGIQGHSDPGGLILLMQDDVGGLQVLHEDHWVVVRPVPNTLVINLGNQLQILSNDIYKSVEHRAVVNSNKERISVATAYGPSMSTLIAPAPQLVNSSSPAVYKGCVYGDFLDSLQSGSLHKKSVLDCLKLDMS

SEQ ID NO: 872 - protein, 347 aa, Physcomitrella patens subsp. patens
  misc_feature (1)..(347): Public GI ID no. 168014854
  misc_feature (1)..(347): Bit score of 206.1 for HMM based on sequences of FIGURE 1.
  misc_feature (124)..(157): Pfam Name: 2OG-FeII_Oxy Pfam Description: 2OG-Fe(II) oxygenase superfamily
  misc_feature (1)..(347): Functional Homolog Of SEQ ID NO. 471
MVQLLVTKGITEIPQKFIQPERSRATVLHPPVETCDLAQLHIPVIDMTGLDGENKDQVIADIAKACEEWGFFQVLNHGVPPSLMRDMRQLSEEFFALSPEEKEVNKIKPGTSVGYGRLFETSTTVANWVDRITIWSYGEQKRTEPCMPPKPERFSLVVAEYSHAVVKLCIRLMEILSMTLGLEPYTLGEHINSKTVGLRTSFNYYPPCPQPELVLGIMPHADTSFITVLQQDKTPGLEIEEDGQWILVPPIPDAFVVNIGDLLQIVSNGRYKSVMHRVLVNNTVGRFSIPNFFMPSKETIIQPLKELLSESNPPLYRSFKFAEYIAGFYIKPLTGRRLIDSFLLDPR

SEQ ID NO: 873 - protein, 349 aa, Zea mays
  misc_feature (1)..(349): Public GI ID no. 194703858
  misc_feature (1)..(349): Bit score of 202.5 for HMM based on sequences of FIGURE 1.
  misc_feature (194)..(291): Pfam Name: 2OG-FeII_Oxy Pfam Description: 2OG-Fe(II) oxygenase superfamily
  misc_feature (1)..(349): Functional Homolog Of SEQ ID NO. 471
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLVPREPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVWSNDRYESAEHRVSVNSARERFSMPYFFNPATYTMVEPVEELVSKDDPPRYDAYNWGDFFSTRKNSNFKKLNVENIQIAHFKKSLVLA

SEQ ID NO: 874 - protein, 351 aa, Medicago truncatula
  misc_feature (1)..(351): Public GI ID no. 357475523
  misc_feature (1)..(351): Bit score of 212.3 for HMM based on sequences of FIGURE 1.
  misc_feature (199)..(297): Pfam Name: 2OG-FeII_Oxy Pfam Description: 2OG-Fe(II) oxygenase superfamily
  misc_feature (1)..(351): Functional Homolog Of SEQ ID NO. 471
MGEVDPAFVQEQEHRPKLSIIEAKGIPEIDLSPILHHAVPNPSDIENLVKEIGSASKEWGFFQVTNHGVPLSLRQRLEEASRLFFAQSLEEKKKVARDEVNPTGYYDTEHTKNVRDWKEVFDFLSQDPTLVPRSSDEHDDGVIQWTNQSPQYPPQFRAILEEYIQEVEKLAYRLLELIALSLGLEAKRFEEFFKYQTSFIRFNHYPPCPYPHLALGVGRHKDAGALTILAQDEVGGLEVKRKSDQQWVLVKPTPDAYIINVGDIIQVWSNDAYESVEHRVMVNSEKERFSIPFFFFPAHDTVVKPLEELTNEENPPKYRPYNWGKFLVNRKSSNFEKKKVENIQIYHYKIA

SEQ ID NO: 875 - protein, 364 aa, Picea sitchensis
  misc_feature (1)..(364): Public GI ID no. 116784279
  misc_feature (1)..(364): Bit score of 196.1 for HMM based on sequences of FIGURE 1.
  misc_feature (218)..(314): Pfam Name: 2OG-FeII_Oxy Pfam Description: 2OG-Fe(II) oxygenase superfamily
  misc_feature (1)..(364): Functional Homolog Of SEQ ID NO. 471
MDSSSAAMDALLKQFERLQRPIDLVQTLHESQVKEVPARYILPSNRRPSRPLQVQQALPVIDLAGLEDIDQRFKTVRQLAQASQEWGFFQIINHGIPLSLLESVKRVSQDFFDLPLEEKRKQCPVRPGTNMLEGYGRFFDISDDTVLDWVDALVHYIFPQWAKAVEHWPKTPSTYRETYEKYGEEVMGLIEKLLGLLSEGLGLDPNYIQILNKEPLVELRINYYPPCPQPDMVNGLKPHSDPNMLTVLLDDGVEGLQVRKDEDWLTVPPVPGALIINIGDMLQIISNGKYKSAEHRAVVNTNQNRMSIVMFLSPQDDVLIDAAPELIDEGHPSLYKAVKAGVYGTVYMSKDLRGKGAVNDLLIE

SEQ ID NO: 876 - protein, 363 aa, Picea sitchensis
  misc_feature (1)..(363): Public GI ID no. 116793277
  misc_feature (1)..(363): Bit score of 192.2 for HMM based on sequences of FIGURE 1.
  misc_feature (210)..(306): Pfam Name: 2OG-FeII_Oxy Pfam Description: 2OG-Fe(II) oxygenase superfamily
  misc_feature (1)..(363): Functional Homolog Of SEQ ID NO. 471
MPSTMEDVLTHEAKANGVEKLMSNGINHLQVQDTYILPPSERPRLSEVSYSESIPVVDLQDLDGPNRTRVVQEICLACEEDGFFQILNHGVPEATMKSMMGIAKEFFEMPVEDRACLYSEDTNQRVRLSTSFNISKEKVLNWRDYLLHPCHPLEEFIGSWPEKPAAYREIAGNYAAEMRALILRLMAAVSEALGLDSDYLNRIFGKHSQLMDIMYYPPCPNPDITLGTPRHSDARGITVLMQGNVSGLQVLRNGKWVAVEPIPNAFVVNMGDQLQVVSNGRFRSVEHRAVTNTSTARISIPTFYGPSEEAFIAPAESLVDEQHPALYKGFKFGEFMKIFWGQELKNKTVLDHFKIEYPENNGK

SEQ ID NO: 877 - protein, 372 aa, Picea sitchensis
  misc_feature (1)..(372): Public GI ID no. 294463977
  misc_feature (1)..(372): Bit score of 194.7 for HMM based on sequences of FIGURE 1.
  misc_feature (220)..(315): Pfam Name: 2OG-FeII_Oxy Pfam Description: 2OG-Fe(II) oxygenase superfamily
  misc_feature (1)..(372): Functional Homolog Of SEQ ID NO. 471
MDSSSAAYDALLKQFERLQRPIDLVQTLHERQLKEVPARYILPSDRRPSRSLQLHQSLPVIDLAGLEDIDQRSKTVRQLAQASQEWGFFQIINHGIPLSLLESVKRISQDFFDLSLEEKQKQCPVRPGIHRLEGYGRLFDISDDMVLDWVDALIHYISPEWAKAVEHWPKTPSTYRETYEKYGEEVMGLIEKLLGLLSEGLGLDPNYIQNLINKEPLLRLRINYYPPCPQPDMVNGLKSHSDVGMLTVLFDDGVDGLQVLKDEDWFTVSPVPGALIINIGDMLQILSNGKYKSAEHRAVANKNQHRMSIVMFLSPEDDVLIGAAPELIDEAHPSLYKAIKAGVYGTVYMSEDNRGKGPLDALLLEQAKQVNV

SEQ ID NO: 878 - protein, 371 aa, Medicago truncatula
  misc_feature (1)..(371): Public GI ID no. 357468779
  misc_feature (1)..(371): Bit score of 217.7 for HMM based on sequences of FIGURE 1.
  misc_feature (39)..(56): Pfam Name: 2OG-FeII_Oxy Pfam Description: 2OG-Fe(II) oxygenase superfamily
  misc_feature (1)..(371): Functional Homolog Of SEQ ID NO. 471
MASEGWPEPVIRVQALAESGISSIPQHFIKPKSQRPTKTNSFTSQTFHHVHDENNKNNINIPVIDLQHLYGEDEKLREETLKRVSEACREWGFFQVLNHGVSHDLMKRAREVWREFFELPLEVKEEYANSPTTYEGYGSRLGVKKGAILDWSDYFFLHYMPCSLRDQTKWPSLPTSLRNVINEYGEEVVKLGGRVLELLSINLGLNDDFLLNAFGGENDLGGCLRVNFYPKCPQPDLTLGLSSHSDPGGLTILLPDDYVSGLQVRRGEDWITVKPVPNAFIINIGDQIQVLSNAIYKSIEHRVIVNSNKDRVSLAFFYNPRSDLLIQPAKELITKDRPALYPPMTFDEYRLYIRTKGPCGKAQVESLVSQK

SEQ ID NO: 879 - protein, 360 aa, Capsicum annuum
  misc_feature (1)..(360): Public GI ID no. 268638403
  misc_feature (1)..(360): Bit score of 229.6 for HMM based on sequences of FIGURE 1.
  misc_feature (212)..(309): Pfam Name: 2OG-FeII_Oxy Pfam Description: 2OG-Fe(II) oxygenase superfamily
  misc_feature (1)..(360): Functional Homolog Of SEQ ID NO. 471
MSLLPSWPEPIIRVQSLSKSGIRKIPHRFVKPPSDRPCNIMDITTTSINIPLIDLENLNSPNDSVRQETIDHISHVCREWGFFQVANHGISHELMEKTRAVWHEFFQLPLEEKQKFANLPMTYEGYGSRIGVEVGAKLDWCDYFFLHYLPQVLKDENKRPCLPVSCRKVISEYGEKMVKLSRRLIKILSIGLGLNEDYVHKSFGGDGESSACLRVNFYPKCPQPDLTLGLSPHSDPGGITILLPDTDISGLQIRRGNNWLTVNPIPNAFIVNIGDQIQVLSNAIYKSVEHRVIVNSNKERLSLAFFYNPGGRALIKPADELVTKDCPALYSPMTFNEYRSFIRTKGPSGKSQIESHKSPR

SEQ ID NO: 880 - protein, 360 aa, Physcomitrella patens
  misc_feature (1)..(360): Public GI ID no. 159902533
  misc_feature (1)..(360): Bit score of 224.7 for HMM based on sequences of FIGURE 1.
  misc_feature (217)..(313): Pfam Name: 2OG-FeII_Oxy Pfam Description: 2OG-Fe(II) oxygenase superfamily
  misc_feature (1)..(360): Functional Homolog Of SEQ ID NO. 471
MTTERERDHKSEVFSKALRDVIVTDNAVPDAYLWPKQELGPMLGHEEFGEDGIPLIDLGGFEELDNNQRRQIYDRIRGACATYGFFQVVNHGVDLRILDRIQAASKKFFDVPLETKEKLECKLEGDRLLGYGFYKSSKLKTQRRNWSEGLFVDKPHIARVSSTVWPEDTDSQTEFSESVEEYVGALRELGLRLTRLILNSLGVYPETYDKYMPKEPALMRLNHYPPCPDPSKTVGLVPHHDANFFTILHQGDVGGLQVKKDEGWVAVRPYPNAFAVNAGNMLQVISNDICKSVLHKAVVNQDSDRYSIAYFVQAPDWDHIAPLPELVDAAHPVKYRPFTWPEYLESQLANPSNALKNFEL

SEQ ID NO: 881 - protein, 371 aa, Picea sitchensis
  misc_feature (1)..(371): Public GI ID no. 224286184
  misc_feature (1)..(371): Bit score of 191.8 for HMM based on sequences of FIGURE 1.
  misc_feature (218)..(314): Pfam Name: 2OG-FeII_Oxy Pfam Description: 2OG-Fe(II) oxygenase superfamily
  misc_feature (1)..(371): Functional Homolog Of SEQ ID NO. 471
MDSSSAAMDALLKQFERLQRPIDLVQTLHERQLKEVPARYILPSDQRPSRPLQVQQSLPVIDLSGLEEIDQRFKIVRQLAQASQEWGFFQIINHGIPLSLLESVKRISQDFFELSLEEKRKQCPVRPGLHMLEGYGRFFDICDDTVLDWVDALVHYISPEWAKAVEHWPKTPSTYRETYEKYGEEVMELMEKLLGLLSEGLGLNPNYIQILNKEPLLQVRINYYPPCPQPDMVNGLKPHSDGDMLTVLLDDGVDGLQVRKDEDWFTVPSIPGALIVNIGDLLQIVSNGKYKSAEHRAVANTNQNRMSIVMFLSPQEDVLIDVAPELIDEGHPRLYKAVGAGAYETEFMSKDLRGKDAVEDLLIGQAEQVNG

SEQ ID NO: 882 - protein, 350 aa, Medicago truncatula
  misc_feature (1)..(350): Public GI ID no. 357475519
  misc_feature (1)..(350): Bit score of 215.2 for HMM based on sequences of FIGURE 1.
  misc_feature (65)..(82): Pfam Name: 2OG-FeII_Oxy Pfam Description: 2OG-Fe(II) oxygenase superfamily
  misc_feature (1)..(350): Functional Homolog Of SEQ ID NO. 471
MGDIEIEPSSHFIQSPEHRPKSSIIIAESIPLIDLSPINYQDDETNSLSIENLVKEIGQACKEWGFFQVINHKVPLDKRERIEESANKFFELSLEEKVKVRRDEVNLLGYFEAEHTKNVRDWKEIYDFNVQQPTFIPPSFQFQWENRWPKNPPEFREACQEYAEEVEKLAYKLMELIAMSLGLVPNRFRDFFIHNTSNIRLNHYPPCPYPHLALGLGRHKDTGVLTVLAQDDVGGLQVKRKSDGEWIQVKPIFNSFIINVGDMIQVWSNDAYESVEHRVMVNSEKDRFSIPFFLKPALYTDVEPLEELTNDKNPPKYSKINWGKFRTARMQNNFIKSNVDNLQIYHFKLS

SEQ ID NO: 883 - protein, 383 aa, Oryza sativa Indica Group
  misc_feature (1)..(383): Public GI ID no. 125562561
  misc_feature (1)..(383): Bit score of 187.8 for HMM based on sequences of FIGURE 1.
  misc_feature (235)..(331): Pfam Name: 2OG-FeII_Oxy Pfam Description: 2OG-Fe(II) oxygenase superfamily
  misc_feature (1)..(383): Functional Homolog Of SEQ ID NO. 471
MAIVDLVNAGEQQQMGSKRAAAEDGDGGVDDSREYYCRRGVRHLCDSGITRLPGNYVLPASDRPGQAAGAAAAAGGSVKLPVVDLSRLRVPSERGVVLRTLDAACREYGFFQVVNHGVGGEVVGGMLDVARRFFELPQPERERYMSADVRAPVRYGTSFNQVRDAVLCWRDFLKLACMPLAAVVESWPTSPADLREVASRYAEANQRVFMEVMEAALEALGVGGGGVMEDLAAGTQMMTVNCYPECPQPELTLGMPPHSDYGFLTLVLQDEVAGLQVMHAGEWLTVDPLPGSFVVNVGDHLEILSNGRYRSVLHRVKVNSRRLRVSVASFHSVAPERVVSPAPELIDDSHPRRYMDTDLATFLAYLASAAGNHKSFLHSRRLY

SEQ ID NO: 884 - protein, 352 aa, Picea sitchensis
  misc_feature (1)..(352): Public GI ID no. 116780785
  misc_feature (1)..(352): Bit score of 192.6 for HMM based on sequences of FIGURE 1.
  misc_feature (207)..(304): Pfam Name: 2OG-FeII_Oxy Pfam Description: 2OG-Fe(II) oxygenase superfamily
  misc_feature (1)..(352): Functional Homolog Of SEQ ID NO. 471
MSSATEVQTQELSSIIEKLISNGINNLQVQDRYILPPHERPQMSEISHSECIPVVDLKDLDGPNRTTIVGEIRRACEEDGFFQILNHGVPENVMKSMMGIAKEFYEMPVEDRACFYSEDIKQPVRLSTSFNIGIDGVLNWVDYFSQPCHPLEEVIGSWPEKPAAYRDIAGKYAGEMRALILRLLAAISEALGLDSDYLNKVLGKHSQLMTLNYYPSCPNPDLTLGLSSHSDATAITVLMQNEVSGLQVFRNGKWVAVEPIANAFVVNLGDQLQVVSNGRFRSIQHRAVTNMYTSRISIPTFYLPGDEAFIAPASSMVDEQQPAVYRGYKFEEFFETFWELKGKSVVDRFKIE

SEQ ID NO: 885 - protein, 384 aa, Picea sitchensis
  misc_feature (1)..(384): Public GI ID no. 116786939
  misc_feature (1)..(384): Bit score of 187.0 for HMM based on sequences of FIGURE 1.
  misc_feature (231)..(327): Pfam Name: 2OG-FeII_Oxy Pfam Description: 2OG-Fe(II) oxygenase superfamily
  misc_feature (1)..(384): Functional Homolog Of SEQ ID NO. 471
MDSSTPIPLPATNMDSSSAAMDALLKQFERLQRPIDLVQTLSERQVKEIPARYILPSDRRPSRPLQVHQSLPVIDLAGLEDIDQRFKIVRQLAQASQEWGFFQIINHGIPLSLLESVKRVSKEFYEISLEEKRKQCPVRPGITMLEGYGRFFDISDDTVLDWVDALVHYISPQWAKAVEYWPKTPSTYRETYEKYGEEVMGLIEKLLGLLSEGLGLDPNYIQILIKEPLLQVRINYYPPCPQPDMVNGLKPHSDGDLMTVLLDDGVEGLQVRKDEDWFTVPPVPRSLIVNIGDLLQIISNGKYKSAEHRAVVNTNQNRMSIGMFLNPQVDVLIDAAPELIDEDHPSLYKAVKAGEYKTVYMSKDFRGKAAVEDLRIEQAKQVNL

SEQ ID NO: 886 - protein, 359 aa, Medicago truncatula
  misc_feature (1)..(359): Public GI ID no. 357461273
  misc_feature (1)..(359): Bit score of 225.3 for HMM based on sequences of FIGURE 1.
  misc_feature (81)..(94): Pfam Name: 2OG-FeII_Oxy Pfam Description: 2OG-Fe(II) oxygenase superfamily
  misc_feature (1)..(359): Functional Homolog Of SEQ ID NO. 471
MLKSHKDWPEPIIRVQSLSEGCKDSIPDRYIKPPTDRPIVDTSSYDDINIPIIDLGGLNGDDLDVHASILKQISDACRDWGFFQIVNHGVSPDLMDKARETWRQFFHLPMEAKQQYANSPTTYEGYGSRLGVEKGAILDWSDYYFLHYLPVSVKDCNKWPASPQSCREVFDEYGKELVKLSGRLMKALSLNLGLEEKILQNAFGGEEIGACMRVNFYPKCPRPELTLGLSSHSDPGGMTMLLPDDQVAGLQVRKFDNWITVNPARHGFIVNIGDQIQVLSNATYKSVEHRVIVNSDQERLSLAFFYNPRSDIPIEPLKQLITPERPALYPAMTFDEYRLFIRMRGPCGKSQVESMKSSK

SEQ ID NO: 887 - protein, 308 aa, Oryza sativa Japonica Group
  misc_feature (1)..(308): Public GI ID no. 222613187
  misc_feature (1)..(308): Bit score of 190.5 for HMM based on sequences of FIGURE 1.
  misc_feature (160)..(259): Pfam Name: 2OG-FeII_Oxy Pfam Description: 2OG-Fe(II) oxygenase superfamily
  misc_feature (1)..(308): Functional Homolog Of SEQ ID NO. 471
MAAEAEQQHQLLSTAVHDTMPGKYVRPESQRPRLDLVVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 888 - protein, 352 aa, Medicago truncatula
  misc_feature (1)..(352): Public GI ID no. 357475529
  misc_feature (1)..(352): Bit score of 223.3 for HMM based on sequences of FIGURE 1.
  misc_feature (60)..(73): Pfam Name: 2OG-FeII_Oxy Pfam Description: 2OG-Fe(II) oxygenase superfamily
  misc_feature (1)..(352): Functional Homolog Of SEQ ID NO. 471
MEEVDQAFIQNPENRPKLSITQAEGIPVINLSPIIHNTVQDSSAIQALVKEISSACKEWGFFQVTNHGVPPTLRLKMEEASKMFFAQSLEDKKKITTDDTGLPGYHDTEHTKNVRDWKEVFDFLSNDPTLVPLNSDEHDDQVTYWTNPSPQYPPHFKVILKEYIKEMEKLAFTLLELIALSLGVEAKRFEEFFIKDQTSFLRLNHYPPCPYPHLALGAGPHKDSGALTILAQDEVGGLEVKRKTDQQWVLVKPTPDAYIINVGDVIQVWSNDAYESVEHRAIVSTEKERFSIPFFLFPGYDAEVKPFEELINEQNPSKYRPYKWGKFLVHRKDSNIKKQDVENLQIYHYKLP

SEQ ID NO: 889 - protein, 368 aa, Physcomitrella patens subsp. patens
  misc_feature (1)..(368): Public GI ID no. 168003319
  misc_feature (1)..(368): Bit score of 184.6 for HMM based on sequences of FIGURE 1.
  misc_feature (199)..(291): Pfam Name: 2OG-FeII_Oxy Pfam Description: 2OG-Fe(II) oxygenase superfamily
  misc_feature (1)..(368): Functional Homolog Of SEQ ID NO. 471
MVQFLVEKGLTEVPPEFLLPKNLRPSSTRMKNIPRTFQIPVIDMAKLNHPDFGENVVREIGRACEEWGFFQVINHGFSAELMQGAMQMCGEFFALPMEEKKLYSMKTSSGIGYGRRMAVKEGVRVDWVDRLGFWSASEEHRKRQPLDVICPAAFNQYGDEILKLAHVILSALSRHAGLDGNYLLDRLGETNTAGVRTGMNYYPPCPQPDLVMGIGQHADGSVLTIVQQDGTPGLEVLKDGLWVPIPAIPEAFVINVGDQIQMISNERYKSVVHRVVAGNGSGRKSISNFFLPNWETVVSPAPRFCTRSNPARYQPVKFSEYITEFMKVPLGEERFVDLFKVPARNEGNQYLISAEGTKGKICPQRFSD

SEQ ID NO: 890 - protein, 350 aa, Arabidopsis lyrata subsp. lyrata
  misc_feature (1)..(350): Public GI ID no. 297809271
  misc_feature (1)..(350): Bit score of 209.2 for HMM based on sequences of FIGURE 1.
  misc_feature (100)..(122): Pfam Name: 2OG-FeII_Oxy Pfam Description: 2OG-Fe(II) oxygenase superfamily
  misc_feature (1)..(350): Functional Homolog Of SEQ ID NO. 471
MATSATSKLLVSDFDSSVSHIPSNYVRPILDRPNLSEVESSSDSIPLIDLRELHGPNRAEVVQQLDSACSTYGFFQIKNHGVPDTTVDKMLTVAREFFHQPESERVKHYSADPTKTTRVSTSFNIGADKILNWRDFLRLHCFPIEDFIEEWPSSPNSFKEVTAEYATSVRALVLRLLEAISESLGLESDHISNILGKHAQHMAFNYYPPCPEPELTYGLPGHKDPTVITVLLQDQVSGLQVFKDNKWVAVNPIPNTFIVNIGDQMQVISNDKYKSVLHRAVVNTEKERLSIPTFYFPSTDAVIGPAHELINEQESLAVYRTFPFVEYWDKFWNRSLATASCLDAFKASTT

SEQ ID NO: 891 - protein, 360 aa, Picea sitchensis
  misc_feature (1)..(360): Public GI ID no. 224284972
  misc_feature (1)..(360): Bit score of 180.0 for HMM based on sequences of FIGURE 1.
  misc_feature (29)..(48): Pfam Name: 2OG-FeII_Oxy Pfam Description: 2OG-Fe(II) oxygenase superfamily
  misc_feature (1)..(360): Functional Homolog Of SEQ ID NO. 471
MAMENWAFTRVQTLADSGIQTIPPEYVRRVEKTHHDPNRFQVPIIDLQLGFSSQQHDQYDSIAAQISRAAENWGFFQIINHGIPDSLIARVQEASKAFFQLPTQEKEAYANEAQNPIGYGSKIGYSPDSEAKLEWGDYYYNAIWPPDMRDMSKWPIQLSDFTESMDEYSRELSKLFELLMEVLSRDLDLESENSLNESVGGERKGLHIRINYYPPCPQPDLVVGLAPHSDPNVLTILLHDQTPGLQIRKNGAWIDVQCVPGALVVNIADQMEILSNGKFKSIEHRGVVHKDRSRMSWAVFCSPPRDVLVSPKRELIDEQHPPLYQGASYGEYLTKFFKKGLDGKGHIHDAKQQDSLVSNS

SEQ ID NO: 892 - protein, 351 aa, Arabidopsis lyrata subsp. lyrata
  misc_feature (1)..(351): Public GI ID no. 297809269
  misc_feature (1)..(351): Bit score of 196.5 for HMM based on sequences of FIGURE 1.
  misc_feature (89)..(122): Pfam Name: 2OG-FeII_Oxy Pfam Description: 2OG-Fe(II) oxygenase superfamily
  misc_feature (1)..(351): Functional Homolog Of SEQ ID NO. 471
MAASATSKLLVSDIASVVDHVPSNYVRPVSDRPNMSEVETFGDSIPLIDLQDLHGPNRANIINQFAHACSSYGFFQIKNHGVPEEIIKQMMNVGREFFHQSESERVKHYSADTKKTTRLSTSFNVSKEKVSNWRDFLRLHCYPIEDFIHEWPSTPVSFREVTAEYATSVRALVLTLLEAISESLGLVKDRVSNTLGKHGQHMAINYYPPCPQPELTYGLPGHKDANLITVLLQDEVSGLQVFEDGKWIAVNPIPNTFIVNLGDQMQVISNDKYKSVLHRAVVNIDKERISIPTFYCPSEDAMIGPAQELINEEEDSHAIYRNFTYAEYFEKFWDTAFATESCIDSFKASTA

SEQ ID NO: 893 - protein, 371 aa, Picea sitchensis
  misc_feature (1)..(371): Public GI ID no. 116794322
  misc_feature (1)..(371): Bit score of 183.1 for HMM based on sequences of FIGURE 1.
  misc_feature (218)..(314): Pfam Name: 2OG-FeII_Oxy Pfam Description: 2OG-Fe(II) oxygenase superfamily
  misc_feature (1)..(371): Functional Homolog Of SEQ ID NO. 471
MDSSSAAMDALLKQFERLQKPIDLVQTLHERQVKEVPARYILPSDQRPSPPLQVQQSLPVIDLAGLEDIDQRFTIVSKIAQASQEWGFFQIINHGIPLSLLESVKGVSQDFFHLSLEEKRKQCPVRPGIHMLEGYGRFFDISDDTVLDWVDALVHYISPEWAKAVEHWPKTPSTYRETYEKYGEEIMGLIEKLLGLLSEGLGLDPNYIQTLDKEPLLQLRINYYPPCPQPDLVNGLRPHSDGDLLTVLLDDGVDGLQVRKDEQWFTVVPVPGSLIINIGDLLQIVSNGKYKSAEHRAVANTNENRMSIVMFLSPQDDVLIGAAPDLIDEAHPSLYKAIKAEEYGTVYMSQDVQGKGPLAALLIDQAKQVNV

SEQ ID NO: 894 - protein, 359 aa, Picea sitchensis
  misc_feature (1)..(359): Public GI ID no. 116792196
  misc_feature (1)..(359): Bit score of 185.3 for HMM based on sequences of FIGURE 1.
  misc_feature (209)..(305): Pfam Name: 2OG-FeII_Oxy Pfam Description: 2OG-Fe(II) oxygenase superfamily
  misc_feature (1)..(359): Functional Homolog Of SEQ ID NO. 471
MAPARVESLALSGLAAIPAEYVRPLEERPTECVLKVKRVEDEGPQIPVVDVAGWDSADEEIKKEIRRQVAKASREWGVMQLLNHGISETLIERLQAAGKAFFDLPVEEKEKYANDHAAGKIAGYGSKLANNASGQLEWEDYYFHLLWPEQRRDMTTWPKHPQEYIDVTDAYGREIRKLVTKILGTLSSDLGVEEERMERVLGGENLEMQLKINYYPRCPQPELALGVEAHTDISALTFLLHNMVPGLQLFYEGKWVTAKCIPGALIVHIGDQVEILSNGKFKSGLHRGLVNKEKVRISWAVFCDPPKDALIGPMKEVVDESNPPLFPAKTFKEHTDHKLFKKAQAQAEAQAAKKLNQST

SEQ ID NO: 895 - protein, 351 aa, Medicago truncatula
  misc_feature (1)..(351): Public GI ID no. 357475525
  misc_feature (1)..(351): Bit score of 213.4 for HMM based on sequences of FIGURE 1.
  misc_feature (200)..(297): Pfam Name: 2OG-FeII_Oxy Pfam Description: 2OG-Fe(II) oxygenase superfamily
  misc_feature (1)..(351): Functional Homolog Of SEQ ID NO. 471
MGEVDPAFVQEQEHRPKLSIIEAKGIPVIDLSPIFHNEVPNPSDIENLVKEIGSACKEWGFFQVTNHGVPSSLRQRLDEAAKLFFAQSLEEKRKVARDEINPTGYYDTEHTKNVRDWKEVLDFLANDPTLVPLNSDENDDQFIQWSNPSPQFPSHFRAIVEEYNEEMEKLAYKLLELIALSLGVEAKRFEEFFKDHTSFIRFNHYPPCPYPHLALGVGRHKDAGALTILAQDDVGGLEVKHKASQEWVLVKPTSDAYIINVCDIIQVWSNDAYESVEHRVMVNKEKERFSIPFFFNPGHDAEIKPLEELTNKQNSPKYKPYKWGKFFVHRLHSNFKKQDEENLQIYHYKLQ

SEQ ID NO: 896 - protein, 375 aa, Medicago truncatula
  misc_feature (1)..(375): Public GI ID no. 357440313
  misc_feature (1)..(375): Bit score of 207.4 for HMM based on sequences of FIGURE 1.
  misc_feature (224)..(318): Pfam Name: 2OG-FeII_Oxy Pfam Description: 2OG-Fe(II) oxygenase superfamily
  misc_feature (1)..(375): Functional Homolog Of SEQ ID NO. 471
MTIFSEDIKRDDDDIENQFLKGVKQLVDNGLHMVPKKYILPPSERPAKNTEDSNFGKQNLQLPIIDFSDLIGPNRPQVLQSLANACERYGFFQVVNHGISEDVINNMMDVCGNFFDLPFEERGKYMTSDMRAAVRYGTSFSQTKDKVFCWRDFLKLICHPLPDYLPHWPDSPVDLRKVAATYAEETKHLFLRLMEAIVESLGIVESNKEEKDNLIKELEDGSQLMAANFYPPCPQPDLTLGMPPHSDYGFLTLLLQDEVEGLQVQFQEQWFTVQPINNTFVVNVGDHLEIYSNGKYKSVLHRVLVNSSKRRRSIASLHSISFNSTVRPSPTLIDKANPKRYADTDFETFLAYISTNETKRKSFLESRKLTSILLD

SEQ ID NO: 897 - protein, 364 aa, Papaver somniferum
  misc_feature (1)..(364): Public GI ID no. 313471276
  misc_feature (1)..(364): Bit score of 199.5 for HMM based on sequences of FIGURE 1.
  misc_feature (216)..(314): Pfam Name: 2OG-FeII_Oxy Pfam Description: 2OG-Fe(II) oxygenase superfamily
  misc_feature (1)..(364): Functional Homolog Of SEQ ID NO. 471
METAKLMKLGNGMSIPSVQELAKLTLAEIPSRYICTVENLQLPVGASVIDDHETVPVIDIENLISSEPVTEKLELDRLHSACKEWGFFQVVNHGVDTSLVDNVKSDIQGFFNLSMNEKIKYGQKDGDVEGFGQAFVASEDQTLDWADIFMILTLPLHLRKPHLFSKLPLPLRETIESYSSEMKKLSMVLFEKMEKALQVQAVEIKEISEVFKDMTQVMRMNYYPPCPQPELAIGLTPHSDFGGLTILLQLNEVEGLQIKNEGRWISVKPLPNAFVVNVGDVLEIMTNGMYRSVDHRAVVNSTKERLSIATFHDPNLESEIGPISSLITPNTPALFRSGSTYGELVEEFHSRKLDGKSFLDSMRM

SEQ ID NO: 898 - protein, 358 aa, Medicago truncatula
  misc_feature (1)..(358): Public GI ID no. 357492715
  misc_feature (1)..(358): Bit score of 225.5 for HMM based on sequences of FIGURE 1.
  misc_feature (210)..(307): Pfam Name: 2OG-FeII_Oxy Pfam Description: 2OG-Fe(II) oxygenase superfamily
  misc_feature (1)..(358): Functional Homolog Of SEQ ID NO. 471
MISPQDWPEPIIRVQSLSESCKDSIPQRYIKPLSDRPSINSILETINNIPIIDLRGLYSTNPHEKASTFKQISEACKEWGFFQIVNHGVSHDLMDLAKETWRQFFHLPMEVKQLYANSPKTYEGYGSRLGVKKGAILDWSDYYYLHYLPLSLKDYNKWPSLPPSCREVFDEYGIELVKLCERLMKVLSINLGLEENFLQNAFGGEDIGACIRVNYFPKCPQPELTLGLSSHSDPGGMTLLLPDDQIHGLQVRKGDNWITVKPVRNAFIVNIGDQIQVLSNAIYRSVEHRVIANSHKERVSLAFFYNPKSDIPIEPAKELVKPDKPALYPAMTFDEYRLFIRMRGPCGKSQVESLKSPR

SEQ ID NO: 899 - protein, 363 aa, Ricinus communis
  misc_feature (1)..(363): Public GI ID no. 255557477
  misc_feature (1)..(363): Bit score of 198.4 for HMM based on sequences of FIGURE 1.
  misc_feature (210)..(307): Pfam Name: 2OG-FeII_Oxy Pfam Description: 2OG-Fe(II) oxygenase superfamily
  misc_feature (1)..(363): Functional Homolog Of SEQ ID NO. 471
METSLEADNFGKSIIVPSVQELAKASLIEIPTRYARLNQDSPIISGDGLSHLCVPVIDLDRLNAGDSVDLELERLHLACREWGFFQLVNHGVSTTLLEVFKLETENFFKLPYEEKKKLWQQPENHEGFGQLFVVSDEQKLDWSDMFYITTLPFNLRKDDLFNKLPPNLRETLETYSNEVKKLAIGILGHMAKALKMDEKELKELFSDGVQSMRMNYYPPCPEPEKAIGFTPHSDADALTILFQLNETEGLQIRKEGRWVSIKPLPNAFVVNIGDIMEIVSNGVYRSIEHRAIVNSTKERLSIATFYSSKLDSLLGPAASLTGSHNPPIFKQVPLEKYFKEFFARKLNGKSYLDFMRIEDAENI

SEQ ID NO: 900 - protein, 365 aa, Medicago truncatula
  misc_feature (1)..(365): Public GI ID no. 358347250
  misc_feature (1)..(365): Bit score of 157.0 for HMM based on sequences of FIGURE 1.
  misc_feature (219)..(315): Pfam Name: 2OG-FeII_Oxy Pfam Description: 2OG-Fe(II) oxygenase superfamily
  misc_feature (1)..(365): Functional Homolog Of SEQ ID NO. 471
MSSSPINTPSPPPYDRVKAVKEFDETKLGVKGLTDSGIKTIPSFFIHPPETLSDLTPRSDFPQPEIPTIDLSAVHHSRSAVVEQIRSAASTFGFFRVINHGVAPDLLQSVIGAIKAFHEQPAEEKEKVYRREMETGVSYISNVDLFNSKAASWRDTLRIKMGPVPADEKEIPEVCRKEVKEWDKEVKRVGDILLGLLSEGLGLGEERLIDMGLSQGRGMVGHYYPFCPQPDLTVGLNSHTDPGALTVLLQDHIGGLQVRTQHGWINVKPLDGALVINIGDFLQIISNEVYKSVDHRVLANPSNEPRVSIAVFFNPGNREKLFGPLPELTSAEKPALYKDFKLNEFLTRFFNKELDGKSFTNFFKK

SEQ ID NO: 901 - protein, 333 aa, Brachypodium distachyon
  misc_feature (1)..(333): Public GI ID no. 357111461
  misc_feature (1)..(333): Bit score of 165.8 for HMM based on sequences of FIGURE 1.
  misc_feature (189)..(284): Pfam Name: 2OG-FeII_Oxy Pfam Description: 2OG-Fe(II) oxygenase superfamily
  misc_feature (1)..(333): Functional Homolog Of SEQ ID NO. 471
MENLLSSAPSHATLPDRFVFPPDQRPPASTCAVSLPVIDLSRGRDEVRRAVLDAGKELGFFQVVNHGVPAEAMRAMEAACEEFFRMPAADKAPFYSEDTGKPSRLFSSTTYEIGGEKYWRDCLRLACGHPVGDTKFAWPDKPQMLRDVVEKFVEPTRAVGMELLRLLCEGMGLRPDYFEGDLTAGDVIINVNHYPPCPAPGLTLGLPPHCDRNLITLLLQSTVPGLQVAYKGDWINVQPVPNAFVVNFGHLLEIATNGLLKSIEHRAMTNGTVARTSVATFLMPPEDSVIGPAEELLGDGDPSRYRTVTFREFMRVYKTVGARRESVEKAFKI

SEQ ID NO: 902 - protein, 364 aa, Ricinus communis
  misc_feature (1)..(364): Public GI ID no. 255575141
  misc_feature (1)..(364): Bit score of 199.5 for HMM based on sequences of FIGURE 1.
  misc_feature (215)..(310): Pfam Name: 2OG-FeII_Oxy Pfam Description: 2OG-Fe(II) oxygenase superfamily
  misc_feature (1)..(364): Functional Homolog Of SEQ ID NO. 471
MEAEGTKSSSSSLGSSLLVPCVQELVKEPMATVPPRYIRPDQDYSIAAPGDDGEVPVIDMQRLYDPDSIDSELAKLHLACKDWGFFQLVNHGISSSLLEKMKMEVQDFFNLPMAEKKKFWQYPGEVEGFGQSFVVSEEQKLDWGDLFFMVTQPAHLRKPHLFPKLPLPFRDTLESYSSEVKNLAVAILEQMAKVLNLKPEEMRDQFTEGIRQTKRMNYYPPCPQPEKVIGLTPHSDGTGLTILLQVNDVEGLQIKKDGKWVPVKPLPNAFVINIGDILEIITNGIYRSILHRATVNSQQKRLSIASFHSPRYDGEIFPAPSLITAQTPSRFRRVTVQEFFKGLFSRELRAKSYLDTLRIEHHEA

SEQ ID NO: 903 - DNA, 1083 bp, Solanum lycopersicum
  misc_feature (1)..(1083): Ceres Annot ID no. 8454419
  misc_feature (1)..(1083): Encodes the peptide sequence at SEQ ID NO. 904
atggattcaaccccggaaaaattgaactttggaaaatctctgttagttccaagtgttcaagagcttgccaaacagcacctaaccattatcccagacaggtatctccggccagagcaagaaactccggtcatttccgccggagcggaggttccagttatcgatgttcaaaagttgatttcaggtgattccatggattctgagctgcaaaagcttcactctgcttgccaacaatggggtttcctacaggttataaaccatggggtgacacctttgctcttggaggacttcaagagagaggttattgaattgttcaaacttccaatggaagaaaagaagaagctatggaaacaggaagacagcttggaaggtttcgggcatgcattcgttgtgtctgaagatcagaaacttgattggagtgacaggtttggcatactgactcttcctcctcatatccgcaaagtggatttgtttcagaagttgccctcgaagctcagggatatcatggaagcatactgcaaagaaattaagagcctagcaacgagcattatatgtcaattggcaaaggctttaaggatggacgaagaggaaatgagagatctattcaatgatggtatgcagacgctgaggatgaattattatccgccttgccctgagccagacaaggcaattggcataagccctcattctgatgccgatgccatcaccatcctcttccagctcaatgaaactgaaggtctccaaatccggaaagacgatgtttgggtgcctataaggcccctcccaaatgcgttgattgtgaatattggggatatgatggagatagtgagcaatggtgtctataggagcattgagcatagagcaatcgtaaactcaaatgaagaacgtctctctgttgcaacattctgtgcgttcaaccttgagtctgagctaggacctgcacacagcctcgttggaccatgtaatcctcctattttccgaagagttcccatgcacaaatatttacaggacttttttgcacgaaaacttgaaggaaagtcataccttgattccatgaaggtagaggcaaaggatgataaatcctag

SEQ ID NO: 904 - protein, 360 aa, Solanum lycopersicum
  misc_feature (1)..(360): Ceres Annot ID no. 8454419
  misc_feature (1)..(360): Bit score of 199.1 for HMM based on sequences of FIGURE 1.
  misc_feature (207)..(302): Pfam Name: 2OG-FeII_Oxy Pfam Description: 2OG-Fe(II) oxygenase superfamily
  misc_feature (1)..(360): Functional Homolog Of SEQ ID NO. 471
MDSTPEKLNFGKSLLVPSVQELAKQHLTIIPDRYLRPEQETPVISAGAEVPVIDVQKLISGDSMDSELQKLHSACQQWGFLQVINHGVTPLLLEDFKREVIELFKLPMEEKKKLWKQEDSLEGFGHAFVVSEDQKLDWSDRFGILTLPPHIRKVDLFQKLPSKLRDIMEAYCKEIKSLATSIICQLAKALRMDEEEMRDLFNDGMQTLRMNYYPPCPEPDKAIGISPHSDADAITILFQLNETEGLQIRKDDVWVPIRPLPNALIVNIGDMMEIVSNGVYRSIEHRAIVNSNEERLSVATFCAFNLESELGPAHSLVGPCNPPIFRRVPMHKYLQDFFARKLEGKSYLDSMKVEAKDDKS

SEQ ID NO: 905 - protein, 363 aa, Arabidopsis lyrata subsp. lyrata
  misc_feature (1)..(363): Public GI ID no. 297820344
  misc_feature (1)..(363): Bit score of 212.6 for HMM based on sequences of FIGURE 1.
  misc_feature (214)..(312): Pfam Name: 2OG-FeII_Oxy Pfam Description: 2OG-Fe(II) oxygenase superfamily
  misc_feature (1)..(363): Functional Homolog Of SEQ ID NO. 471
MNIFQDWPEPIVRVQSLSESNLGAIPNRYVKPLSQRPNITTHNKHNPHTTTIPIIDLGRLYTDDLTLQAKTLDEISKACREWGFFQVVNHGMSPQLMDQAKATWREFFHLPMELKNMHANSPKTYEGYGSRLGVEKGAILDWSDYYYLHYQPSSLKDYTKWPSLPLHCREILEDYCKEMVKLCEKLMKILSKNLGLQEDRLQNAFGGKEESGGCLRVNYYPKCPQPELTLGISPHSDPGGLTILLPDEQVAGLQVRGSDDAWITVEPAPHAFIVNIGDQIQMLSNSIYKSVEHRVIVSPANERLSLAFFYNPKGNVPIEPLKEIVTVDSPALYSSTTYDRYRQFIRTQGPRSKCHIDELKSPR

SEQ ID NO: 906 - protein, 368 aa, Aethusa cynapium
  misc_feature (1)..(368): Public GI ID no. 110618325
  misc_feature (1)..(368): Bit score of 181.5 for HMM based on sequences of FIGURE 1.
  misc_feature (196)..(295): Pfam Name: 2OG-FeII_Oxy Pfam Description: 2OG-Fe(II) oxygenase superfamily
  misc_feature (1)..(368): Functional Homolog Of SEQ ID NO. 471
MAPTTLTALAQEKTLNSKFVRDEDERPKVAYNQFSNEIPVISLAGIDDDSGDKRSQICRKIVEACEDWGIFQVVDHGIDSHLISEMTRLAREFFALPAEEKLRFDMTGGKKGGFIVSSHLQGEAVQDWREIVTFFSYPVPARDYSRWPDKPEGWRSVTEVYSEKLMALGCKLLEVLSEAMGLEKETITKACVDMDQKVIVNYYPKCPQPDLTLGLKRHTDPGTITLLLQDQVGGLQATRDGGKTWITVQPVEGAFVVNLGDHGHYLSNGRFKNADHQAVVNSDSSRMSIATFQNPAPNATVYPLKIREGEKSVMEEAITFAEMYRRKMSKDIEVAKLKKLAKEKLLQDQDTEKAKLQTKPKSADEIFA

SEQ ID NO: 907 - protein, 358 aa, Brassica rapa subsp. campestris
  misc_feature (1)..(358): Public GI ID no. 166798287
  misc_feature (1)..(358): Bit score of 176.2 for HMM based on sequences of FIGURE 1.
  misc_feature (195)..(294): Pfam Name: 2OG-FeII_Oxy Pfam Description: 2OG-Fe(II) oxygenase superfamily
  misc_feature (1)..(358): Functional Homolog Of SEQ ID NO. 471
MAPGTLTELAGETKLNSKFVRDEDERPKVAYNEFSTEIPVISLAGIDDVGGKRGEICRQIVEACENWGVFQVVDHGVDTSLVADMTRLARDFFALPPEEKLKFDMSGGKKGGFIVSSHLQGESVQDWREIVTYFSYPVRNRDYSRWPTKPEGWVKVTEEYSERLMGLACKLLEVLSEAMGLEKEALTNACVDMDQKIVVNYYPKCPQPDLTLGLKRHTDPGTITLLLQDQVGGLQATRDDGKTWITVQPVEGAVVVNLGDHGHYLSNGRFKNADHQAVVNSNSSRLSIATFQNPAPEATVYPLKVREGEKPILEEPITFAEMYRRKMSRDIELARLKKLAKEEHDHKEAAKPLDQIIA

SEQ ID NO: 908 - protein, 368 aa, Ammi majus
  misc_feature (1)..(368): Public GI ID no. 60476845
  misc_feature (1)..(368): Bit score of 179.3 for HMM based on sequences of FIGURE 1.
  misc_feature (196)..(295): Pfam Name: 2OG-FeII_Oxy Pfam Description: 2OG-Fe(II) oxygenase superfamily
  misc_feature (1)..(368): Functional Homolog Of SEQ ID NO. 471
MAPTTLTALAQEKTLNSKFVRDEDERPKIAYNQFSDEIPVISLAGIDDDSDDKRSQICRKIVEACEGWGIFQVVDHGIDTDLISEMTRLAREFFALPAEEKLRFDMTGGKKGGFIVSSHLQGEAVQDWREIVTYFSYPVPARDYSRWPDKPEGWRSVTEVYSDKLMGLACKLLEVLSEAMGLEKEALTKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLKIREGEKAVMEEPITFAEMYKRKMSKDIEMAKLKKLAKEKLLQEQEAEKAKLQMTPKSADEIFA

SEQ ID NO: 909 - protein, 364 aa, Fragaria x ananassa
  misc_feature (1)..(364): Public GI ID no. 51493449
  misc_feature (1)..(364): Bit score of 176.0 for HMM based on sequences of FIGURE 1.
  misc_feature (197)..(296): Pfam Name: 2OG-FeII_Oxy Pfam Description: 2OG-Fe(II) oxygenase superfamily
  misc_feature (1)..(364): Functional Homolog Of SEQ ID NO. 471
MAPTPTTLTAIAGENTLQQSFVRDEDERPKVAYNQFSIDIPIISLSGIEEVEGRRAEICKKIVEACEDWGVFQIVDHGIDPKLISEMTRLAREFFALPPEEKLRFDMSGGKKGGFIVSSHLQGEAVQDWREIVTYFSYPVRHRDYSRWPDKPEGWRDVTTQYSDELMGLACKLLEVLSEAMGLEKEALTKACVDMDQKVVVNFYPKCPQPDLTLGLKRHTDPGTITLLLQDQVGGLQATRDGGKTWITVQPVEGAFVVNLGDHGHFLSNGRFKNADHQAVVNSNHSRLSIATFQNPAQEAIVYPLKVREGEKPILEEPMTYTEMYKKKMSKDLELARLKKHAKEQLQDSEKTKLEAKPVDDIFA

SEQ ID NO: 910 - protein, 360 aa, Prunus avium
  misc_feature (1)..(360): Public GI ID no. 326366179
  misc_feature (1)..(360): Bit score of 170.3 for HMM based on sequences of FIGURE 1.
  misc_feature (195)..(294): Pfam Name: 2OG-FeII_Oxy Pfam Description: 2OG-Fe(II) oxygenase superfamily
  misc_feature (1)..(360): Functional Homolog Of SEQ ID NO. 471
MAPATTLTSIAGEKTLQQKFVRDEDERPKVAYNNFSNEIPIISLAGIDEEGRRAEICKKIVEACEDWGIYQIVDHGVDAKLISEMTGLAREFFALPSEEKLRFDMSGGKKGGFIVSSHLQGEAVQDWREIVTYFSYPIRHRDYSRWPDKPEGWREVTQKYSDELMGLACKLLGVLSEAMGLDTEALTKACVDMDQKVVVNFYPKCPQPDLTLGLKRHTDPGTITLLLQDQVGGLQATRDGGKTWITVQPVEGAFVVNLGDHGHLLSNGRFKNADHQAVVNSNSSRLSIATFQNPAQEAIVYPLSIREGEKPILEGPITYTEMYKKKMGRDLELARLKKLAKEQQSQDLKKETKSADDIFA

SEQ ID NO: 911 - protein, 340 aa, Ginkgo biloba
  misc_feature (1)..(340): Public GI ID no. 42566572
  misc_feature (1)..(340): Bit score of 157.8 for HMM based on sequences of FIGURE 1.
  misc_feature (205)..(301): Pfam Name: 2OG-FeII_Oxy Pfam Description: 2OG-Fe(II) oxygenase superfamily
  misc_feature (1)..(340): Functional Homolog Of SEQ ID NO. 471
MAPTRVQYVAESRPQTIPLEFVRPVEERPINTTFNDDIGLGRQIPVIDMCSLEAPELRVKTFKEIARASKEWGIFQVINHAISPLLFESLETVGKQFFQLPQEEKEAYACTGEDGSSTGYGTKLACTTDGRQGWSDFFFHMLWPPSLRDFSKWPQKPSSYIEVTEEYSKGILGVLNKLLSALSISLELQESALKDALGGENLEMELKINYYPTCPQPEVAFGVVPHTDMSALTILKPNDVPGLQVWKDEKWITAHYVPNALIIHIGDQIQILSNGKFKSVLHRSLVNKEKVRMSWPVFCSPPLDTVIGPLKELIDDSNPPLYNARTYREYKHRKINKLGQ

SEQ ID NO: 912 - protein, 368 aa, Camellia chekiangoleosa
  misc_feature (1)..(368): Public GI ID no. 378749126
  misc_feature (1)..(368): Bit score of 174.9 for HMM based on sequences of FIGURE 1.
  misc_feature (72)..(91): Pfam Name: 2OG-FeII_Oxy Pfam Description: 2OG-Fe(II) oxygenase superfamily
  misc_feature (1)..(368): Functional Homolog Of SEQ ID NO. 471
MAPTTTLTALAQEKSLQQKFVRDEDERPKAAYNVFSNEIPVISLAGIDEIEGRRSEICRKIVEACEDWGIFQVVDHGVDANLVAEMTRLAREFFALPPEEKLRFDMSGGKKGGFIVSSHLQGEAVQDWREIVTYFSYPIRARDYSRWPDKPEGWRAVTETYSEKLMDLACKLLEVLSEAMGLEKEALTKACVDMDQKVVVNFYPKCPQPDLTLGLKRHTDPGTITLLLQDQVGGLQATRDGGKTWITVQPVEGAFVVNLGDHGHYLSNGRFKNADHQAVVNSNCSRLSIATFQNPAPEATVYPLKIREGEKPVLEEPITFADMYKRKMSKDIELAKLKKLAKEKKLLQDQQDIEKAKLEIKSTDEIFA

SEQ ID NO: 913 - protein, 366 aa, Actinidia chinensis
  misc_feature (1)..(366): Public GI ID no. 219944305
  misc_feature (1)..(366): Bit score of 170.7 for HMM based on sequences of FIGURE 1.
  misc_feature (196)..(295): Pfam Name: 2OG-FeII_Oxy Pfam Description: 2OG-Fe(II) oxygenase superfamily
  misc_feature (1)..(366): Functional Homolog Of SEQ ID NO. 471
MAPTTTLTALAEEKTLQSKFVRDEDERPKVAYNVFSSEIPVISLAGIDEVDGRRSEICRKIVEACEDWGIFQVVDHGVDAKLVGEMTRLARDFFALPPEEKLRFDMSGGKKGGFIVSSHLQGEAVQDWREIVTYFSYPIRARDYSRWPDKPDGWRAVTQAYSENLMGLACKLLEVLSEAMGLEKEALTKACIDMDQKVVVNFYPKCPQPDLTLGLKRHTDPGTITLLLQDQVGGLQATRDGGKTWITVQPVDGAFVVNLGDHGHYLSNGRFKNADHQAVVNSNCSRLSIATFQNPAPEATVYPLAIQEGEKPVLEEPITFAEMYRRKMSKDLELARLKKLAKETQLQEQELEKAKLGAKGVEEIFA

SEQ ID NO: 914 - protein, 368 aa, Ipomoea coccinea
  misc_feature (1)..(368): Public GI ID no. 366047645
  misc_feature (1)..(368): Bit score of 167.3 for HMM based on sequences of FIGURE 1.
  misc_feature (196)..(295): Pfam Name: 2OG-FeII_Oxy Pfam Description: 2OG-Fe(II) oxygenase superfamily
  misc_feature (1)..(368): Functional Homolog Of SEQ ID NO. 471
MTTLSTLTALAGETALRSSFVRDEDERPKVGYNEFSDEIPVISLKGIDDFLGRRVQICNDIVKACEDWGIFQVVDHGVDAELIGEMTRLSKDFFSLPPEEKLRFDMSGGKKGGFIVSSHLQGEAVKDWREIVTYFSYPIKARDYSRWPDKPEGWRAVTEKYSEKLMDLACKLLEVLSEAMGLENEALTKACVEMDQKLVVNFYPKCPQPDLTLGLKRHTDPGTITLLLQDQVGGLQATKDGGKTWITVQPVDGAFVVNLGDHGHFLSNGRFKNADHQAVVNSERSRVSIATFQNPAPEAKVYPLKVREGEKPILEEPITFAEMYRRKMSKDLELARMKKFSKEQKQQMIIKAAADTNLETKPIDQILA

SEQ ID NO: 915 - protein, 354 aa, Brassica rapa subsp. pekinensis
  misc_feature (1)..(354): Public GI ID no. 237682460
  misc_feature (1)..(354): Bit score of 155.2 for HMM based on sequences of FIGURE 1.
  misc_feature (207)..(302): Pfam Name: 2OG-FeII_Oxy Pfam Description: 2OG-Fe(II) oxygenase superfamily
  misc_feature (1)..(354): Functional Homolog Of SEQ ID NO. 471
MLDRASEVKTFDEMKMGVKGLVEAGMTKIPRIFHNPLASVTTPKPPSTVRIPTIDLRGGVFDSEVTRQSVVAKVKEAMEKFGFFQAINHGIPLHVMEEMEAGIRGFHGQDPEARKMFYSRDKTKKVKYNSNVDLYDSPAASWRDTLSLFLAPDVPKAEDLPEICGEIILEYSQGVMKLAELIFELLSESLGLSRNHLKELDCAKGLLMLCHCYPPCPEPDLTLGATQHTDRSFVTILLQDHIGGLQVLHDGYWIDVPPTPGALILNTGDLLQLITNDKFVSVEHRVLANGRDEPRTSVASFFVHPSSSSRVYGPIKELLSEQNPPKYRDTTAEASNHYVPRKGVGNASLSHLRI

SEQ ID NO: 916 - protein, 367 aa, Fagopyrum tataricum
  misc_feature (1)..(367): Public GI ID no. 333362482
  misc_feature (1)..(367): Bit score of 172.1 for HMM based on sequences of FIGURE 1.
  misc_feature (199)..(298): Pfam Name: 2OG-FeII_Oxy Pfam Description: 2OG-Fe(II) oxygenase superfamily
  misc_feature (1)..(367): Functional Homolog Of SEQ ID NO. 471
MAGSAKPKTLTALSEETTLNTSFVRDEDERPKVAYNQFSNDIPVISLAGIDDLGGKRDEICKKIVDACEDWGVFQVVDHGVDTKLVSEMTRLARDFFALPAEDKLKFDMTGGKKGGFIVSSHLQGEAVQDWREIVTYFSYPLKARDYSRWPDKPEGWVKVTEHYSEQLMGLACKLLGVLSEAMGLETEALTKACVDMDQKVVVNYYPKCPQPDLTLGLKRHTDPGTITLLLQDQVGGLQVTRDDGKTWITVQPVEGAFVVNLGDHGHYLSNGRFKNADHQAVVNSNFSRLSIATFQNPVPDATVYPLAVREGETLILEAPITFAEMYRRKMGKDLELARLKKLAKEQAQQNLDKAKVEPKPIEEILA

SEQ ID NO: 917 - protein, 375 aa, Glycine soja
  misc_feature (1)..(375): Public GI ID no. 169793771
  misc_feature (1)..(375): Bit score of 172.1 for HMM based on sequences of FIGURE 1.
  misc_feature (197)..(296): Pfam Name: 2OG-FeII_Oxy Pfam Description: 2OG-Fe(II) oxygenase superfamily
  misc_feature (1)..(375): Functional Homolog Of SEQ ID NO. 471
MAPTAKTLTYLAQEKTLESSFVRDEEERPKVAYNEFSDEIPVISLAGIDEVDGRRREICEKIVEACENWGIFQVVDHGVDQQLVAEMTRLAKEFFALPPDEKLRFDMSGAKKGGFIVSSHLQGESVQDWREIVIYFSYPKRERDYSRWPHKPEGWRWATEEYSEKLMGLAGKLMEVLSEAMGLEKEGLSKACVDMDQKVVVNYYPKCPQPDLTLGLKRHTDPGTITLLLQDQVGGLQATRDNGKTWITVQPVEAAFVVNLGDHAHYLTNGRFKNADHQAVVNSNHSRLSIATFQNPALNATVYPLKVREGEKPVMEEPITFAEMYRRKMSKDLEIAGMKKLAKEKHLQDLENEKHLQELDQKAKLEAKPLKEILA

SEQ ID NO: 918 - protein, 356 aa, Callistephus chinensis
  misc_feature (1)..(356): Public GI ID no. 729503
  misc_feature (1)..(356): Bit score of 171.6 for HMM based on sequences of FIGURE 1.
  misc_feature (193)..(292): Pfam Name: 2OG-FeII_Oxy Pfam Description: 2OG-Fe(II) oxygenase superfamily
  misc_feature (1)..(356): Functional Homolog Of SEQ ID NO. 471
MAAPISLKWEEHSLHENKFVRDEDERPKVPYNTFSNEIPVISLAGIDGCRRAEICDEIVKACEDWGIFQVVDHGVDTKLLSDMTGLARDFFHLPTQEKLRFDMTGGKKGGFIVSSHLQGEAVQDWREIVTYFSYPIKARDYSRWPDKPNEWRAVTEEYSKVLMGLACKLLEVLSEAMGLEKEALTKACVDMDQKVVVNYYPKCPQPDLTLGLKRHTDPGTITLLLQDQVGGLQATRDGGESWITVKPVEGAFVVNLGDHGHYLSNGRFKNADHQAVVNSSTSRLSIATFQNPAPEAIVYPLKINEGEKSIMEEPMTFMEMYKKKMSTDLELARLKKLAKDKQQDLEVVKPIQNIFA

SEQ ID NO: 919 - protein, 335 aa, Antirrhinum majus
  misc_feature (1)..(335): Public GI ID no. 80973282
  misc_feature (1)..(335): Bit score of 177.9 for HMM based on sequences of FIGURE 1.
  misc_feature (200)..(296): Pfam Name: 2OG-FeII_Oxy Pfam Description: 2OG-Fe(II) oxygenase superfamily
  misc_feature (1)..(335): Functional Homolog Of SEQ ID NO. 471
MEGERVQAIASLSKYADTIPSEFIRSENEQPAATTLRGVVLEVPVIDLSDDFNEKILVKNISEASRDWGIFQVVNHGISNEVISKLQKVGKEFFELPKEEKEFVAKTPESGIEGYGTILQKEVEGKKGWVDHLFHKIWPPSAINYKFWPKNPPSYREANEEYTKKIRDVSDKLTNWLSLGLGIKGHELKAAMGGDDTIFLMKINYYPPCPRPDLALGVVAHTDMSFLTILVPNEVQGLQVFRDEHWYDVKYIPNALIVHIGDQIEILSNGKYKAVFHRTTVNKKNTRMSWPVFLEPHPEFEVGPIPELVSEESPSKYKTKKYKDYVYCKLNKIPQ

SEQ ID NO: 920 - protein, 358 aa, Solanum tuberosum
  misc_feature (1)..(358): Public GI ID no. 21392365
  misc_feature (1)..(358): Bit score of 169.4 for HMM based on sequences of FIGURE 1.
  misc_feature (194)..(293): Pfam Name: 2OG-FeII_Oxy Pfam Description: 2OG-Fe(II) oxygenase superfamily
  misc_feature (1)..(358): Functional Homolog Of SEQ ID NO. 471
MASTLTALANEKTLQTSFIRDEEERPKVAYNKFSDEIPVISLQGIDDINGRRSEICEKIVNACEDWGVFQVIDHGADAQLISEMTKLAKEFFELPPDEKLRFDMSGGKKGGFIVSSHLQGEVVQDWREIVTYFSYPIRARDYSRWPDKPQGWIAVTEKYSEKLMDLACKLLEVLSEAMGLEKEALTKACVDMDQKVVVNFYPKCPEPDLTLGLKRHTDPGTITLLLQDQVGGLQATKDNGKTWITVQPVEGAFVVNLGDHGHYLSNGRFKNADHQAVVNSNSSRLSIATFQNPAPDAKVYPLKIREGEKAIMDEPITFAEMYRRKMSKDLELARLKKLAKEQTEEAKLESKPIEEILA

SEQ ID NO: 921 - protein, 354 aa, Garcinia mangostana
  misc_feature (1)..(354): Public GI ID no. 222478425
  misc_feature (1)..(354): Bit score of 172.8 for HMM based on sequences of FIGURE 1.
  misc_feature (212)..(308): Pfam Name: 2OG-FeII_Oxy Pfam Description: 2OG-Fe(II) oxygenase superfamily
  misc_feature (1)..(354): Functional Homolog Of SEQ ID NO. 471
MVTSVAPRVETLASSGIQCIPKEYIRPQEELTNLGNIFEQEKKEGPQVPTIDLEGIVSEDKEVRDKCWDELMKAAKEWGVMHLVNHGISNELTEKVKIAGEAFFQLPIEEKEKYANDQGSGMIQGYGSKLANNASGRLEWEDYFFHLVFPEEKRDLSIWPKTPSDYIEVTSEYARQLRALATKVLSALSLCLGLEEGRLEKEVGGIEELALQMKINYYPKCPQPELALGVEAHTDVSALTFILHNMVPGLQLFYEGEWVTAKCVPNSIIMHIGDTLEILSNGKLKSILHRGVVNKEKVRISWAVFCEPPKDKIILKPLPELVSETEPPMFPPRTFSQHIQHKLFRKNQDDVGPN

SEQ ID NO: 922 - protein, 346 aa, Nicotiana tabacum
  misc_feature (1)..(346): Public GI ID no. 164454785
  misc_feature (1)..(346): Bit score of 163.0 for HMM based on sequences of FIGURE 1.
  misc_feature (212)..(307): Pfam Name: 2OG-FeII_Oxy Pfam Description: 2OG-Fe(II) oxygenase superfamily
  misc_feature (1)..(346): Functional Homolog Of SEQ ID NO. 471
MKTAEAQSATTLTMEVARVQAIASITKCMDTIPSEYIRSENEQPASTTLHGVLLQVPVIDIDDKNVVKLISDASKEWGIFQVINHGIPDEVIANLQKVGKEFFEVVPQEEKEVIAKTPGSQNIEGYGTSLQKELEGKRGWVDHLFHKIWPPSAINYRYWPKNPPSYREANEEYAKRLREVVEKIFKSLSLGLGLGAHEMMEAAGGEDIVYLLKINYYPPCPRPDLALGVVAHTDMSHITILVPNEVQGLQVFKDGHWYDVKYIPNALIVHIGDQVEILSNGKYKSVYHRTTVTKDKTRMSWPVFLEPPSEHEVGPISKLVNEANPPKFKTKKYKDYVYCKLNKLPQ

SEQ ID NO: 923 - protein, 357 aa, Citrus sinensis
  misc_feature (1)..(357): Public GI ID no. 46850468
  misc_feature (1)..(357): Bit score of 168.7 for HMM based on sequences of FIGURE 1.
  misc_feature (213)..(309): Pfam Name: 2OG-FeII_Oxy Pfam Description: 2OG-Fe(II) oxygenase superfamily
  misc_feature (1)..(357): Functional Homolog Of SEQ ID NO. 471
MVTPTARRVESLARSGIQAIPKEYVRPKEELMGIGNIFEEEEKDEGPQVPTIDLKEIDSEDRVEREKCREELKKAAMDWGVMHLVNHGISDDLTERVKRAGQAFFDQPVEEKEKYANEQASGKIQGYGSKLANNASGQLEWEDYFFHLIYPEDKRDMSIWPKTPSDYTEATSEYARQLRSLATKILAVLSLGLGLEEGRLEKEVGGLEELLLQMKINYYPKCPQPELALGVEAHTDVSALTFILHNMVPGLQLFYKDKWVTAKCVPNSIILHIGDTIEILSNGEYKSILHRGLVNKEKVRISWAVFCEPPKDKIILKPLPETVSEQKPAMFPPRTFQQHIEHKLFRRTQDALLSDEE

SEQ ID NO: 924 - protein, 352 aa, Solanum tuberosum
  misc_feature (1)..(352): Public GI ID no. 225194715
  misc_feature (1)..(352): Bit score of 165.0 for HMM based on sequences of FIGURE 1.
  misc_feature (217)..(313): Pfam Name: 2OG-FeII_Oxy Pfam Description: 2OG-Fe(II) oxygenase superfamily
  misc_feature (1)..(352): Functional Homolog Of SEQ ID NO. 471
MKTIQGQSATTALTMEVARVQAISSITKCMDTIPSEYIRSENEQPAATTLQGVVLEVPVIDISNVDDDEEKLVKEIVEASKEWGIFQVINHGIPDEVIENLQKVGKEFFEEVPQEEKELIAKKPGAQSLEGYGTSLQKEIEGKKGWVDHLFHKIWPPSAINYRYWPKNPPSYREANEEYAKWLRKVADGIFRSLSLGLGLEGHEMMEAAGSEDIVYMLKINYYPPCPRPDLALGVVAHTDMSYITLLVPNEVQGLQVFKDGHWYDVNYIPNAIIVHIGDQVEILSNGKYKSVYHRTTVNKYKTRMSWPVFLEPSSEHEVGPIPKLINEANPPKFKTKKYKDYVYCKLNKLPQ

SEQ ID NO: 925 - protein, 320 aa, Pseudomonas sp. 2_1_26
  misc_feature (1)..(320): Public GI ID no. 355645974
  misc_feature (1)..(320): Bit score of 138.1 for HMM based on sequences of FIGURE 1.
  misc_feature (175)..(274): Pfam Name: 2OG-FeII_Oxy Pfam Description: 2OG-Fe(II) oxygenase superfamily
  misc_feature (1)..(320): Functional Homolog Of SEQ ID NO. 471
MDRLPIIDIAPLYGADRGAWNDVARRIDQACREWGFFYIAGHPLPAARFEALLAAAREFFALPVEEKLKIDITRSRNHRGYGAIATEQLDPALPSDFKETFDMALHLPAEHPDVRAGKSFYGPNRHPELPGWEALLEGHYADMLALARTVLRALAIALGIEEDFFDRRFEQPVSVFRLIHYPPAAARQSADQPGAGAHTDYGCVTLLYQDAAGGLQVQNRQGEWIDAPPIDGTFVVNIGDMMARWSNDRYRSTPHRVISPRGVHRYSMPFFAEPHMDTEIRCLPGCFDADNPPKYPPTTCGEWLTSRFAQTYAYRRGETA

SEQ ID NO: 926 - protein, 352 aa, Solanum demissum
  misc_feature (1)..(352): Public GI ID no. 113205138
  misc_feature (1)..(352): Bit score of 138.5 for HMM based on sequences of FIGURE 1.
  misc_feature (207)..(300): Pfam Name: 2OG-FeII_Oxy Pfam Description: 2OG-Fe(II) oxygenase superfamily
  misc_feature (1)..(352): Functional Homolog Of SEQ ID NO. 471
MASLVSSWSSEVNSIPEKYVVPLEKRVNADVPIGKHIPVIDLSQSSTQSIQQIIKASADFGLFQVINHGVSETLMVDALSVCKEFFKLPIEDKAKFVEKDEGLSDFEPSIDQRPKLYIEKEYTPNKNGSNTNNGKDTVFWKDTFGHGCHPLTQDVINSWPEKPQKYREVIGEYALELRKLSLRILDLMCEGLGLEVGYLTREHSQTQLMVTHHYPQCPDPNSTIGIGEHCDGALINLVQQELSGLHVRDKDGKWFGVEPIPGALVVINGLILKVVTNGKLSSGVHRVVTNSTSDRTSLGSLISPIECIIEPAKLLINESNPPLFKSFSYTEYLGYYFSDTTEIEAALKPYKL

SEQ ID NO: 927 - protein, 356 aa, Matthiola incana
  misc_feature (1)..(356): Public GI ID no. 2570827
  misc_feature (1)..(356): Bit score of 163.5 for HMM based on sequences of FIGURE 1.
  misc_feature (211)..(307): Pfam Name: 2OG-FeII_Oxy Pfam Description: 2OG-Fe(II) oxygenase superfamily
  misc_feature (1)..(356): Functional Homolog Of SEQ ID NO. 471
MVAVERVESLAESGIKSIPKEYIRPKEELESINDVFQEEKKEDGPQVPTIDLQNIESEDEETREKCVEELKKAALDWGVMHLINHGIPVDLMERVKKSGQEFFGLPVEEKEKYANDQASGKIQGYGSKLANNASGQLEWEDYFFHLVYPQDKRDLSLWPKTPTDYIEATSEYAKCLRSLATKVFKALSIGLGLEPHRLEKQVGGFEDLLLQMKINYYPKCPQPELALGVEAHTDVSALTFILHNMVPGLQLFYEGKWVTAKCVPDSIIMHIGDTLEILSNGKFKSILHRGLVNKEKVRVSWAVFCEPPKDKIVLKPLPEMVSVESPAKFPPRTFAQHIEHKLFRKEQEELVSEKKA

SEQ ID NO: 928 - protein, 358 aa, Brassica oleracea var. alboglabra
  misc_feature (1)..(358): Public GI ID no. 300834841
  misc_feature (1)..(358): Bit score of 157.5 for HMM based on sequences of FIGURE 1.
  misc_feature (211)..(307): Pfam Name: 2OG-FeII_Oxy Pfam Description: 2OG-Fe(II) oxygenase superfamily
  misc_feature (1)..(358): Functional Homolog Of SEQ ID NO. 471
MVAVERVESLAKSGINSIPKEYIRPKEELESINDVFQEEKKEDGPQVPTIDLQDIESEDETIREKCIEELKKAAMDWGVMHLINHGVPVELMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTFILHNMVPGLQLFYEGKWVIAKCVPDSIVMHIGDTLEILGNGKFKSILHRGLVNKEKVRISWAVFCEPPKEKIVLKPLPEMVSVESPAKFPPRTFAQHIEHKLFRNEQEELVTEKKDEV

SEQ ID NO: 929 - protein, 372 aa, Catharanthus roseus
  misc_feature (1)..(372): Public GI ID no. 157169280
  misc_feature (1)..(372): Bit score of 148.9 for HMM based on sequences of FIGURE 1.
  misc_feature (217)..(310): Pfam Name: 2OG-FeII_Oxy Pfam Description: 2OG-Fe(II) oxygenase superfamily
  misc_feature (1)..(372): Functional Homolog Of SEQ ID NO. 471
MKELNNSEEELKAFDDTKAGVKALVDSGITEIPRIFLDHPTNLDQISSKDREPKFKKNIPVIDLDGISTNSEIRREIVEKIREASEKWGFFQIVNHGIPQEVMDDMIVGIRRFHEQDNEIKKQFYTRDRTKSFRYTSNFVLNPKIACNWRDTFECTMAPHQPNPQDLPDICRDIMMKYISYTRNLGLTLFELLSEALGLKSNRLKDMHCDEGVELVGHYYPACPQPELTLGTSKHTDTGFLTMLQQDQIGGLQVLYENHQWVDVPFIPGALIINIGDFLQIISNDKFKSAPHRVLANKNGPRISTASVFMPNFLESAEVRLYGPIKELLSEENPPIYEQITAKDYVTVQFSRGLDGDSFLSPFMLNKDNMEK

SEQ ID NO: 930 - protein, 347 aa, Phytophthora sojae
  misc_feature (1)..(347): Public GI ID no. 348686932
  misc_feature (1)..(347): Bit score of 145.1 for HMM based on sequences of FIGURE 1.
  misc_feature (188)..(288): Pfam Name: 2OG-FeII_Oxy Pfam Description: 2OG-Fe(II) oxygenase superfamily
  misc_feature (1)..(347): Functional Homolog Of SEQ ID NO. 471
MTVPEVPVVDIGALVGFSSDADASIALRDSKDDALRLIIDQVRAAASEWGFFYVANHGLSQGEVDQFQETMRSFFRLPDEVKRTIPRTATNARGFVEGELTKNKTDWKQCFDFSVPNEDGPVSDNHDRMGDDHNLWLEEDVLPGFRTEMRAYYSRMEFISRRLLKVFAVALGEEPAFFDQFFLDDHSSLMRLNYYPVAPDPEKTMGVYHHTDPGALAVLLQDDEVATLQVFHRKTQSWVNVPPRKGTYTINIGDLVQIWSNDKFKAPIHRVLATDKADRFSAPFFYLPAYNVQVKPIVVKEGEVPNYRPFSWREFLLKRVSGNYADSGKENQIGDFKIHDAIDVANS

SEQ ID NO: 931 - protein, 381 aa, Thalassiosira pseudonana CCMP1335
  misc_feature (1)..(381): Public GI ID no. 223997880
  misc_feature (1)..(381): Bit score of 130.8 for HMM based on sequences of FIGURE 1.
  misc_feature (184)..(286): Pfam Name: 2OG-FeII_Oxy Pfam Description: 2OG-Fe(II) oxygenase superfamily
  misc_feature (1)..(381): Functional Homolog Of SEQ ID NO. 471
MKFPTFTSNNDDEIPIIDLANPDKTTLHRQLFEACSTWGFFQLINHNIDQSLVSSFQLAMIDVFALPYDTKLKLKRNARNARGYFDDELTKRRRDWKECLDVGSPGARDWSVKDFDDVNACLDGFNQFPTLNDCPKFRDTIVEYFDACSRLSNILAKLMAASLGLDDESAEVEFFRRMMGDHTSYLRMNYYPPYPPPLGVSPHRDAGFLTILLQDDDCHSLQVARFEDADDTADNWVTVHPIPGALTINTGDMAMIWSNGRFRAPLHRVLTNAEKKRYSAPFFYNPGYNELISPLDCCCRNEDGDNAELQPTKYQPCLWGYFRALRFAGDLTDLGVEIQTSHFRVGTQSKHVEKQSLFMKEVNFQQPFDVEKYRHILEDKD

SEQ ID NO: 932 - protein, 318 aa, Ipomoea trifida
  misc_feature (1)..(318): Public GI ID no. 194371667
  misc_feature (1)..(318): Bit score of 150.3 for HMM based on sequences of FIGURE 1.
  misc_feature (171)..(267): Pfam Name: 2OG-FeII_Oxy Pfam Description: 2OG-Fe(II) oxygenase superfamily
  misc_feature (1)..(318): Functional Homolog Of SEQ ID NO. 471
MDGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSLGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 933 - protein, 362 aa, Eustoma exaltatum subsp. russellianum
  misc_feature (1)..(362): Public GI ID no. 297306658
  misc_feature (1)..(362): Bit score of 156.2 for HMM based on sequences of FIGURE 1.
  misc_feature (215)..(309): Pfam Name: 2OG-FeII_Oxy Pfam Description: 2OG-Fe(II) oxygenase superfamily
  misc_feature (1)..(362): Functional Homolog Of SEQ ID NO. 471
  misc_feature (280)..(280): Xaa is any aa, unknown, or other
MGIPVVPRVESLARSGTQEIPKEYVRTKEELTSIADVFAEEKNDEGPQVPMIDIKDIDSADISVRERCHDVLNKAAIEWGVMHLVNHGISSDLIGRVKSAGQAFFDLPVEEKEKYANDQASGNVQGYGSKLANNASGQLEWEDYFFHCIFPEEKRDMTIWPKTPEDYIPSTNEYAKQLRALASKILGVLSLGLGLEAGRLEKEVGGLEELILQKKINYYPKCPQPELALGVEAHTDISALTFILHNMVPGLQLFYEGKWITAKCVPNSIIMHVGDTIEIXSNGKYKSILHRGLVNKEKVRISWAVFCEPPKEKIVLKPLPETLSESEPARFPPRTFAEHIKHKLFRKSEETNEDNNLPKGSS

SEQ ID NO: 934 - protein, 371 aa, Ipomoea purpurea
  misc_feature (1)..(371): Public GI ID no. 158515829
  misc_feature (1)..(371): Bit score of 153.9 for HMM based on sequences of FIGURE 1.
  misc_feature (217)..(313): Pfam Name: 2OG-FeII_Oxy Pfam Description: 2OG-Fe(II) oxygenase superfamily
  misc_feature (1)..(371): Functional Homolog Of SEQ ID NO. 471
MLSTITATVPSRVERLAGSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLLYGGKWVTAKCVPNSIIMHVGDTVEILSNGKYKSILHRGVVNKEKVRVSWAVFCEPPKDKILLQPLPETVSEAEPPRFPPRTFAQHIKHKLFRQSDQEAADTPKPDNDDDHQSN

SEQ ID NO: 935 - protein, 368 aa, Ipomoea horsfalliae
  misc_feature (1)..(368): Public GI ID no. 241898888
  misc_feature (1)..(368): Bit score of 152.6 for HMM based on sequences of FIGURE 1.
  misc_feature (217)..(313): Pfam Name: 2OG-FeII_Oxy Pfam Description: 2OG-Fe(II) oxygenase superfamily
  misc_feature (1)..(368): Functional Homolog Of SEQ ID NO. 471
MVTTITATVPSRVERLAGSGIERIPKEYIRPEEERTSIGDIFEEEKMAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKSPSDYIAATREYAKQLRALATKVLAVLSLGLGLEEGRLEKEVGGMEELLLQTKINYYPKCPQPELALGVEAHTDVSALSFILHNMVPGLQLFYQGKWVTAKCVPNSIIMHVGDTIEILSNGKYKSILHRGVVNREKVRVSWAVFCEPPKDKILLQPLPETVSEAEPPRFPPRTFAQHIKHKLFRQSDQEADTPKPDDDHQSN

SEQ ID NO: 936 - protein, 355 aa, Gerbera hybrid cultivar
  misc_feature (1)..(355): Public GI ID no. 62824273
  misc_feature (1)..(355): Bit score of 165.5 for HMM based on sequences of FIGURE 1.
  misc_feature (213)..(309): Pfam Name: 2OG-FeII_Oxy Pfam Description: 2OG-Fe(II) oxygenase superfamily
  misc_feature (1)..(355): Functional Homolog Of SEQ ID NO. 471
MVIQATTRVESLSTSGIHQIPKEYIRPQEELRSITNIFDEETNKQKPQVPTVDLTDIESDDPEKRHKCSEELKKAAMEWGVMHVVNHGVSGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLIYDGQWVSAQCVPDSIILRIGDTLEILSNGKYKSILHRGLVNKEKVRISWAVFCEPPKEKIVLKPLPETVSEAEPPLFPPRTFQQHMEHKLFRKNKDEVMQN

SEQ ID NO: 937 - protein, 321 aa, Dianthus caryophyllus
  misc_feature (1)..(321): Public GI ID no. 520802
  misc_feature (1)..(321): Bit score of 146.3 for HMM based on sequences of FIGURE 1.
  misc_feature (163)..(259): Pfam Name: 2OG-FeII_Oxy Pfam Description: 2OG-Fe(II) oxygenase superfamily
  misc_feature (1)..(321): Functional Homolog Of SEQ ID NO. 471
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKGYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 938 - protein, 324 aa, Burkholderia sp. CCGE1003
  misc_feature (1)..(324): Public GI ID no. 307727667
  misc_feature (1)..(324): Bit score of 148.1 for HMM based on sequences of FIGURE 1.
  misc_feature (177)..(276): Pfam Name: 2OG-FeII_Oxy Pfam Description: 2OG-Fe(II) oxygenase superfamily
  misc_feature (1)..(324): Functional Homolog Of SEQ ID NO. 471
MPVTRIPLIDFAGVRAGDPRALHDVARQIREACTTIGFFYIVNHGVPQAVIDAAAQAARSFFAFPVETKRRAAVNHRHRGFNALGDATMYQAKRPDYKEFFSIGLELPEDDPDVLAGQALRGPNNWPDFMPQLRPALYGYYEAVGACGADLLRAVAVSLGVDEHFFASRYTKRMQRTQMVYYPPQPPQSDEDQFGVAPHTDYGCITLLWQDQVGGLQVREIANDTWVDAPPVEGSFVVNVGDLLARWTNDRFRSTLHRVINASGRERYSIATFYDPTYGAIVDPRDLGANADDLKYQPVAAGDYILGRINDSMGYRKKHAAPTT

SEQ ID NO: 939 - protein, 330 aa, Oryza minuta
  misc_feature (1)..(330): Public GI ID no. 359359094
  misc_feature (1)..(330): Bit score of 94.3 for HMM based on sequences of FIGURE 1.
  misc_feature (182)..(275): Pfam Name: 2OG-FeII_Oxy Pfam Description: 2OG-Fe(II) oxygenase superfamily
  misc_feature (1)..(330): Functional Homolog Of SEQ ID NO. 471
MPAVAGSLYMASQHKGVPPLPPRPLPVINLGRLTMDSASRALAVRDIVLACRERGCFEVVNHGISRSCMNGALEAASEFFQLSTERKEEFASDDIRQPIRYDTSSRDGISMSRSFLKHYANPLDDWIKFWPTQPPTYREKMGEYAVETQRVSMQLMEAILQGLGLGPSYLQEKLEGGVQFVALNNYPQSSAKKADNIGLATHSDYGFLTILLQSSPGLEVMHHEDDDWTPVPAIPGALHVHVGDHLEVLSNGRLKSLVHRAVLNPNESRISIASIHGLSMDEEVHCAEELIDEDHPRMYRGSSFQDFLDFLPANMNKYKRFVESLRIDKP

SEQ ID NO: 940 - protein, 360 aa, Aspergillus niger CBS 513.88
  misc_feature (1)..(360): Public GI ID no. 145248559
  misc_feature (1)..(360): Bit score of 115.0 for HMM based on sequences of FIGURE 1.
  misc_feature (218)..(314): Pfam Name: 2OG-FeII_Oxy Pfam Description: 2OG-Fe(II) oxygenase superfamily
  misc_feature (1)..(360): Functional Homolog Of SEQ ID NO. 471
MTAMARPQYTHVELLTLNGPEYRRVSTAPPRPPSDDEIPVIDLVGIDGDLDSRTVIAGKIRTAAQNTGFFYIKNHGISEDLIASALTQAKAFFHQPEEEKEKVSNFKLLHMDGYHAVGTTQVNKSETKDRKETFSLRYNARNDPSTGPDTPEARIWDDSPLWAGTAHLPTFREITISFWQARLALARKLVRIFALALDLSEDYFDSVVTHPGADGLYIHYPGIPEPELKGESIDVGIGSHTDIQCFTLLWQDMSGGLQVLSSSDEWLDARPIPGTLVVNIGDFLQRLSNNRFRSTVHRVYNRQSASRYSMPFFFGFNPETVCQVVPSCVDEEHPALYEPISCGKWHRDRLALAQGKLATA

SEQ ID NO: 941 - protein, 320 aa, Sphingobacterium spiritivorum ATCC 33300
  misc_feature (1)..(320): Public GI ID no. 227536376
  misc_feature (1)..(320): Bit score of 109.8 for HMM based on sequences of FIGURE 1.
  misc_feature (194)..(279): Pfam Name: 2OG-FeII_Oxy Pfam Description: 2OG-Fe(II) oxygenase superfamily
  misc_feature (1)..(320): Functional Homolog Of SEQ ID NO. 471
MALVNIPRLDLLNYTSGSKEQREQFIQDIGKAFNETGFVTIANHGLSKALIDELYQVVPAFFALPDDIKYQYEFPELAGQRGYTTKGREKAKDSKTPDLKEFWQRGQTIVGEEYSKTDFPDNPEVKELPRFNTITAEVYKKLEDTGRELLKAIATYLDLEENYFEQYVINGNSILRAIHYFPILHPEELAPDAVRAGAHEDINLITLLIGASADGLEVLTKDGEWYPIKAKGEDIVINVGDMLQRLTNNKLKSTTHRVVNPPLEKMGTSRFSIPFFLHPKSSMSLACLSSCIDEKHPKAYPDYTAGEYLDERLREIGLKM

SEQ ID NO: 942 - protein, 324 aa, Pseudomonas stutzeri ATCC 17588 = LMG 11199
  misc_feature (1)..(324): Public GI ID no. 339495204
  misc_feature (1)..(324): Bit score of 135.8 for HMM based on sequences of FIGURE 1.
  misc_feature (176)..(275): Pfam Name: 2OG-FeII_Oxy Pfam Description: 2OG-Fe(II) oxygenase superfamily
  misc_feature (1)..(324): Functional Homolog Of SEQ ID NO. 471
MNSLPVIDISPLYNADEAGHLAVAEAIDRACREWGFFYIKGHPISAERIATCTDHAKRFFALPADEKLKIDITKSRHHRGYGAVATEQLDPSQPCDLKETFDMGFHMPADHPEVLAGKPLRGPNRHPLQIEGWTELMEGHYRDMQDLACTLLRAIALALGIERDFFDKRFVEPISVFRMIHYPPRQTATSADQQGAGAHTDYGCVTLLYQDQAGGLQVQNVKGEWIDAPPIEGTYVVNIGDMMARWSNDRYKSTPHRVISPLGVDRYSMPFFAEPHPDTEIACLPGCYDETNPPKYPSTTCSRYMLSRFAETYAYRRQGEAEPV

SEQ ID NO: 943 - protein, 314 aa, Sphingobium chlorophenolicum L-1
  misc_feature (1)..(314): Public GI ID no. 334344062
  misc_feature (1)..(314): Bit score of 89.8 for HMM based on sequences of FIGURE 1.
  misc_feature (171)..(271): Pfam Name: 2OG-FeII_Oxy Pfam Description: 2OG-Fe(II) oxygenase superfamily
  misc_feature (1)..(314): Functional Homolog Of SEQ ID NO. 471
MSQPVLEQVPVLSMAEMAKADFSTAFGGSFQRFGFAMVKDHGMDQALIDKGWALARQFFALPEEAKRRYDARYNGGQRGYTAFGVEIAKGASENDLKEFWHVGRDLPEGDPLAETMPPNVWPDELPEFHETFAKLYAEFDRVGAELLSAIALYLGLEERWFDKPVENGNSILRLLHYPPVSAEAPGIRAGAHEDINLITLLLGAEEGGLELKDRGGNWLPVVPPPGALAINVGDMLQRLTNYALPSTSHRVVNPPPERRGHSRYSMPFFLHLRPDFLIDALPQCVDTDHPRRDPPITAHDYLTERLREIGLIKG

SEQ ID NO: 944 - protein, 323 aa, Ostreococcus lucimarinus CCE9901
  misc_feature (1)..(323): Public GI ID no. 145352595
  misc_feature (1)..(323): Bit score of 95.8 for HMM based on sequences of FIGURE 1.
  misc_feature (179)..(281): Pfam Name: 2OG-FeII_Oxy Pfam Description: 2OG-Fe(II) oxygenase superfamily
  misc_feature (1)..(323): Functional Homolog Of SEQ ID NO. 471
MTPAVTREDAREKVPTVSLELYAKDFEKFVHDLGEAYERYGFVILENHGIDLELIERAMERSKAFFACDEECKKKYTLRGLGGARGYTAFGVETAKGANAPDLKEFWHLGRDLPAGHKYESTMPPNVDDVVEVEGFSEVNKQIFNALDELGNCVLEALAVHLEQPREYFADKTNEGNSILRIIHYPPIPPDAAGRVRAGAHEDINLITLLLGADEGGLQLLGKDGEWLEVNPPPGCVTCNIGDMLQRLSNHKLPSTTHRVVNPPAERAHIPRYSMPFFLHPNPDFVIKTLESCISDQYPNRYPEPISSDEYLQQRLREIKLKS

SEQ ID NO: 945 - protein, 337 aa, Mesorhizobium australicum WSM2073
  misc_feature (1)..(337): Public GI ID no. 354570727
  misc_feature (1)..(337): Bit score of 105.7 for HMM based on sequences of FIGURE 1.
  misc_feature (190)..(286): Pfam Name: 2OG-FeII_Oxy Pfam Description: 2OG-Fe(II) oxygenase superfamily
  misc_feature (1)..(337): Functional Homolog Of SEQ ID NO. 471
MDAQERGDFSEIPILDVSPLYGDDEGAIRETAATLRRYLETIGFLYVTGHPIPRTDVEAVREASKRFFALPEEEKAKLKIDKNFRGYLPFAGSTIVTSSVAAVSKPNQSESIFFMHEVGADDPRALAGKPLQGPNQWPDEAALAGFRETIERYVQEMGTLARKMVRAIALSLGLPSDSLDRYFEQPTTFLRLLHYPTQPQEEGLFGSAPHTDYGFITLLAQDNVGGLEVKNKAGDWVPAPPVPDSFVMNVGDILARWSNDQFVSTPHRVINRSGRERYSQPFFFDPSMDETIAALSVCVPAGTQPKYEPVLYGDYLMERIDKNYHYRKKKAAEAAAS

SEQ ID NO: 946 - protein, 321 aa, Pseudomonas syringae pv. syringae B728a
  misc_feature (1)..(321): Public GI ID no. 66043929
  misc_feature (1)..(321): Bit score of 121.4 for HMM based on sequences of FIGURE 1.
  misc_feature (175)..(274): Pfam Name: 2OG-FeII_Oxy Pfam Description: 2OG-Fe(II) oxygenase superfamily
  misc_feature (1)..(321): Functional Homolog Of SEQ ID NO. 471
MDQLPVIDIAPLYGTETQAWQDVARQIDSACRAWGFFYIKGHPISAQRIEQVQSAAKDFFARPAAEKLLIDITQSTHHRGYGAIATEQLDPSLPSDLKETFDMGLHLDARHPDVLAGKPLRGPNRHPDIPGWETLMEQHYLDMQALAQTLLRAMTLALGIERDFFDQRFKDPVSVLRMIHYPPRGTATSAEQQGAGAHTDYGCITLLYQDTAGGLQVRDVRGEWIDAPPLDGTFVVNLGDMMARWSNDRYLSTPHRVISPLGVDRYSMPFFAEPHPDTRIECLPGCQSDDHPARYPVTTCAEFLLSRFADTYAYRREQEAS

SEQ ID NO: 947 - protein, 347 aa, Nectria haematococca mpVI 77-13-4
  misc_feature (1)..(347): Public GI ID no. 302884057
  misc_feature (1)..(347): Bit score of 100.9 for HMM based on sequences of FIGURE 1.
  misc_feature (21)..(56): Pfam Name: 2OG-FeII_Oxy Pfam Description: 2OG-Fe(II) oxygenase superfamily
  misc_feature (1)..(347): Functional Homolog Of SEQ ID NO. 471
MAQLEIPIIDFSGFYSEDPTRKQAVVDQVRQSCLYNGFFQITGHSVPLQQQKQALACAKKFFSLSQAEKDEVSKDKTTWNRGYEMLRSQILEEGTQPELKEGFYIGDDIPKTHPYFVNKKLNSGPNQWPEALGDDLTDFKNHSMEYYHSTLKLASDLMRVLALSLDLEETYFSRFLDGAVATMRLLHYPSQPADADEKLTRGIGAHTDFGAITMLLQDKVDGLQVWDQKNNVWIDVPPTEGALVVNLGNLMARWTNEKYKSNVHRVINKSGNERYSIPVFVSGNPDYVVDCIPTCKAAQDPAKFEPATVEQVVSASYAESYGRAQLYKQGLQKTIDSQVKPAGVAAA

SEQ ID NO: 948 - protein, 326 aa, Pseudomonas stutzeri ATCC 14405 = CCUG 16156
  misc_feature (1)..(326): Public GI ID no. 379063357
  misc_feature (1)..(326): Bit score of 132.6 for HMM based on sequences of FIGURE 1.
  misc_feature (187)..(285): Pfam Name: 2OG-FeII_Oxy Pfam Description: 2OG-Fe(II) oxygenase superfamily
  misc_feature (1)..(326): Functional Homolog Of SEQ ID NO. 471
MNQTLSARHLEAAALPLIDIAGLFSPDLAYRTAVAERIGAACREVGFFCVANHGVDPALQQAVFEQARTFFAQPEAGKRALDKVFSKANRGYEPLRGQVLEAGAPADLKEGFYIGEELAEDDPRVLAGRFNHGANQWPSELADFRPTMERYRDAMNALAARLMGAIALSLQLPEEHFASFCRDSMSTLRLLHYPPQPANAAPGEKGCGAHTDFGGLTLLLQDENPGLQVWDRHSKSWIHAAPVPGTYVVNLGDMIARWTNDQYRSTLHRVVNISGRERYSVPFFFSGNPDHLVECLPTCLAPGKAPRYPAVTVEEHHREMYRRTYG

SEQ ID NO: 949 - protein, 352 aa, Ochrobactrum anthropi ATCC 49188
  misc_feature (1)..(352): Public GI ID no. 153011110
  misc_feature (1)..(352): Bit score of 94.7 for HMM based on sequences of FIGURE 1.
  misc_feature (182)..(278): Pfam Name: 2OG-FeII_Oxy Pfam Description: 2OG-Fe(II) oxygenase superfamily
  misc_feature (1)..(352): Functional Homolog Of SEQ ID NO. 471
MTIHTTPINLPLLDLSRFNGSAEERDSFIEELRRTLHEHGFFYLTGHGVDPKLVEDVVATAKTFFALPTEEKLKIEMVKSSHFRGYNRAGLERTRGEQDWREQLDINTESEPAEIGPNSPAWKRLIGPNQWPEALPELKPLLLAYQAEVTRVGIDILKAIAAALGQPEGFFAQIYEPHPSQLLKIIRYPGRDIAESEQGVGAHKDGGFVTVLLQDIIPGLRVQREDGEWIDAPPVPGTFVINTGELLELATNGFVRADVHGVVAPPAGVERFSVAFFLGARYDATIPVIDLPDELKTKERGVTVDTLNPIFREVGANNLKSRLRSHPDVARAHHADLLTPEQLADRSPGSTY

SEQ ID NO: 950 - protein, 397 aa, Schizosaccharomyces pombe 972h-
  misc_feature (1)..(397): Public GI ID no. 19115385
  misc_feature (1)..(397): Bit score of 87.2 for HMM based on sequences of FIGURE 1.
  misc_feature (257)..(352): Pfam Name: 2OG-FeII_Oxy Pfam Description: 2OG-Fe(II) oxygenase superfamily
  misc_feature (1)..(397): Functional Homolog Of SEQ ID NO. 471
MLSQLIERSTQYVREASLEEQNRIMPLIDFGPYVNQEPGAHERIIQQLRAACESTGFFQIVNSPISPDVVKNAFRASKQFFELPFDEKLTLSKDMFSNRGYELMEDFVLEGEEDSSSPLEISGIDFEAGSYPGEAPLPPSSIGYVLPPSSLANGEGSSMFDADMTTSNAVAHGDESISNEFRESFYFGNDNLSKDRLLRPFQGPNKWPSTAGSSFRKALVKYHDQMLAFANHVMSLLAESLELSPDAFDEFCSDPTTSIRLLRYPSSPNRLGVQEHTDADALTLMSQDNVKGLEILDPVSNCFLSVSPAPGALIANLGDIMAILTNNRYKSSMHRVCNNSGSDRYTIPFFLQGNIDYVVAPLPGLGPSTAEPIAVEDLLRDHFQNSYTSHTTSLEVA

SEQ ID NO: 951 - protein, 297 aa, Elaeis guineensis
  misc_feature (1)..(297): Public GI ID no. 30060226
  misc_feature (1)..(297): Bit score of 114.8 for HMM based on sequences of FIGURE 1.
  misc_feature (154)..(250): Pfam Name: 2OG-FeII_Oxy Pfam Description: 2OG-Fe(II) oxygenase superfamily
  misc_feature (1)..(297): Functional Homolog Of SEQ ID NO. 471
MAVPVINLRELDGDRRTETKSLLHEACEKWGFFWVENHGIKEALMEKVKGLVNSHYEEYLKQSFYESELAMGLGPQTQSSEADWESTYFIQHQPESNNIHDIPGHEIEFCEAMEDYIRQLIKLAETLAELMSENLGLDKCYLKEAFSPAFVGTKVAKYPQCPQPKLLMGLRARTDGGGIILLLQDDMVPGLEFFKHGKWVPITPKKDNRIFVNLGDQVEVMSNGLYKSILHRVAADKDGSRLSIATFYNPGADAIISPAPKLLYPGGYRFKDYLDYYTGTKFSDKGARFQTIKDMFK

SEQ ID NO: 952 - protein, 382 aa, Phaeosphaeria nodorum SN15
  misc_feature (1)..(382): Public GI ID no. 169615517
  misc_feature (1)..(382): Bit score of 105.6 for HMM based on sequences of FIGURE 1.
  misc_feature (225)..(324): Pfam Name: 2OG-FeII_Oxy Pfam Description: 2OG-Fe(II) oxygenase superfamily
  misc_feature (1)..(382): Functional Homolog Of SEQ ID NO. 471
MATAAVVTAPPTDRTTYEEAHNGAAAYLQSRLAVKDEALDKDFSVPVIDLAPSFSPILADRQAVAEQIRKACTTSGFFYIANHGVSKQARDGILEQSKRFYDELSLEQKEDLHIKKNQLGLGWEPSEYTSIAGDQERKEGFNFSYEAALDPTGGDGLYRNLDGTDYRGNMWPKEEDLPGFRAAVKEYYGGVLSLARHLFRLFALSLDLPETYFDSMATHPGGIARLLYYPPPKRAQPAISDQEQIGLGAHSDYECFTLLLTSSTPGLEILKPSGKWHIASQEPNTFIINVADFLMRWTNGLYKSTVHRVVNRSTEARYSVPFFFSVNYDTVVETLPTCLREGEVSPWKPIRAGEYILERLNATTKNAYGFKGNEAIHDEKEA

SEQ ID NO: 953 - protein, 320 aa, Pedobacter sp. BAL39
  misc_feature (1)..(320): Public GI ID no. 149280311
  misc_feature (1)..(320): Bit score of 103.5 for HMM based on sequences of FIGURE 1.
  misc_feature (182)..(279): Pfam Name: 2OG-FeII_Oxy Pfam Description: 2OG-Fe(II) oxygenase superfamily
  misc_feature (1)..(320): Functional Homolog Of SEQ ID NO. 471
MSTPYIPSLDLGSYINGNDAQRKKFSDELGRAFNDSGFVTITNHGLSQELIDKLYQNIQAMFSLSPDQKKKYEKIALAGQRGYTSPGKETAKGAKTADLKEFWQIGQEVLDNDPIKFEYPANEYLEEIPEFNEVTREIYQRLESNGKHLLRAIATYLELPVDYFDQHVHNGNSILRGIHYFPIENPDALPDDAVRAGAHEDINLITLLIGASADGLEVLTRNGEWLPIKAGHTDIVVNVGDMLQRLTNNKLRSTTHRVVNPPRELMKTSRFSVPFFLHPRANMDLASLPSTIDAEHPKVYSDMTAGEYLDERLREIGLKM

SEQ ID NO: 954 - protein, 327 aa, Metarhizium anisopliae ARSEF 23
  misc_feature (1)..(327): Public GI ID no. 322705051
  misc_feature (1)..(327): Bit score of 71.1 for HMM based on sequences of FIGURE 1.
  misc_feature (22)..(58): Pfam Name: 2OG-FeII_Oxy Pfam Description: 2OG-Fe(II) oxygenase superfamily
  misc_feature (1)..(327): Functional Homolog Of SEQ ID NO. 471
MGSKTPDAIPTIDISDFISPTSTEAQKQAVVDNVRHACTTYGFFQAVGHGVTVDEQKEILDCTRRFFALPEEDRMEVCVSKSMGKSLRGYEPPLIQTHHKGLMPDIKETFMVGAEIPPDHPDAGSFSTGPNLWPSKIPEDQFRKPVMDYQAKMVNLAKVLLKILGRGLPKEWGHPPSVLEKLAENPSIPMRMLHYAPQEVLHDTQFGVADHTDFGCITILLQEAVSKGLEVWYPPTETWIPVPPTEGAYVINMSDMMMKLTGGYYRSARHRVVTNHRNHRYSVAFFLNGNLKLVAKALDGSGTEVVIGEHIRQRLIETLGKTGEMLK

SEQ ID NO: 955 - protein, 342 aa, marine actinobacterium PHSC20C1
  misc_feature (1)..(342): Public GI ID no. 88856654
  misc_feature (1)..(342): Bit score of 92.8 for HMM based on sequences of FIGURE 1.
  misc_feature (178)..(276): Pfam Name: 2OG-FeII_Oxy Pfam Description: 2OG-Fe(II) oxygenase superfamily
  misc_feature (1)..(342): Functional Homolog Of SEQ ID NO. 471
MDDSALPVIDLSLLDGSPESAAKFRDDLLCATHDVGFFYLVGHGVDESLMDDLLAASREFFDLPEDQKFAVENVKSPQFRGYTRVGGELTEGKTDWREQIDVGPERDVIDNAPGLADYWRLEGPNLWPDAVPQLRGLVNEWNDKLSAVSLRLLRAWAHALGAPEDVFDNAFADKPFPQLKIVRYPGESNPEPKQGVGAHRDGGVLTLLMVEPGKGGLQVDYNGEWVDVPPKPGAFVVNIGEMLELATEGYLKATLHRVISPLIGDDRISIPFFFNPALDTVMPQLQLPPELAAQARGLSLDPTNSPILETYGDNALRYRMRAHPNVAQIHHDDLIQGPRGAI

SEQ ID NO: 956 - protein, 356 aa, Aeromonas hydrophila subsp. hydrophila ATCC 7966
  misc_feature (1)..(356): Public GI ID no. 117617896
  misc_feature (1)..(356): Bit score of 81.0 for HMM based on sequences of FIGURE 1.
  misc_feature (177)..(273): Pfam Name: 2OG-FeII_Oxy Pfam Description: 2OG-Fe(II) oxygenase superfamily
  misc_feature (1)..(356): Functional Homolog Of SEQ ID NO. 471
MEHSPLPIIDLAALDGAPETRRQMLATLGRAAREVGFFYLIGHGLSEQEQQETLALAARFFALPQQEKLAVQMVHSPHFRGYNQVGAELTRARPDLREQFDIMNEEAALDAASLQHPWQRLIGPNQWPTALPEMKSHLLAWQERLSAITLTLLAAFAEVLEQPAGVFDESIRGAPHQHMKLIHYPGQAAGGSGQGVGAHKDPGYLTLVMQDHHSGLEVETADGWISAPPLPGALVVNIGELLELASNGYLKATLHRVQSPPPGVSRLSCAFFMAARLDATVPLLSLSPALAAQAQGPESDPTNPLFYQVGENVLKGRLRSHPDVATRHYGIAPASANAQTSSEQTAKRERREPQLA

SEQ ID NO: 957 - protein, 315 aa, Sphingobium yanoikuyae XLDN2-5
  misc_feature (1)..(315): Public GI ID no. 381201565
  misc_feature (1)..(315): Bit score of 70.5 for HMM based on sequences of FIGURE 1.
  misc_feature (171)..(271): Pfam Name: 2OG-FeII_Oxy Pfam Description: 2OG-Fe(II) oxygenase superfamily
  misc_feature (1)..(315): Functional Homolog Of SEQ ID NO. 471
MSQSVLDQVPVLSMAEMSKGDFAAAFGGSFQRFGFAMVKDHGMDQALVDKGWALAREFFAQPVEMKRAYDAKFNGGQRGYTAFGVEIAKGASENDLKEFWHVGRDLAPGDPLAETMPPNVWPTEMPAFRDVFAPLYAEFDRVGAELLSAIALYLGLPERWFDGPIKDGNSILRLLHYPPVSPEAPGIRAGAHEDINLITLLLGAEEGGLELKDRDGNWLPVVPPPGALAINVGDMLQRLTNHVLPSTSHRVVNPPPERRGHSRYSMPFFLHLRPDFMIDALPQCVTPDNPRREEPISAHDYLTERLIEIGLIKKA

SEQ ID NO: 958 - protein, 329 aa, Laccaria bicolor S238N-H82
  misc_feature (1)..(329): Public GI ID no. 170089053
  misc_feature (1)..(329): Bit score of 63.3 for HMM based on sequences of FIGURE 1.
  misc_feature (42)..(55): Pfam Name: 2OG-FeII_Oxy Pfam Description: 2OG-Fe(II) oxygenase superfamily
  misc_feature (1)..(329): Functional Homolog Of SEQ ID NO. 471
MSLIAISEDGHFQEVPVIDLQDIRSDDPILRGALASQVRDACMRVGFFYVSNHGIPEHIIDGVLEMSKRFFALSTESKMKIEHRKTSNFMGYSPLLSGNNDPDNAGDLQEGFEFGWEELDAAPKFHPDESGPMAGANVWPSELELPGFLQCMADRVCSHSAVNLGQAMFPLFALALNQTEDFFDNKATLMKLLHYPPQTETVDERVIGIGAHTDWECFTILWQQPDLQALQVLNSDKKWINAPPIPGTLVINLGDQFARWTNDIFKSTVHRAINRSGVRRYSIPLFFGTDYNVKLEPIPSCVSPDRPLKYEVITAGEYVKSRLQATYNH

SEQ ID NO: 959 - protein, 319 aa, Solitalea canadensis DSM 3403
  misc_feature (1)..(319): Public GI ID no. 379655258
  misc_feature (1)..(319): Bit score of 99.3 for HMM based on sequences of FIGURE 1.
  misc_feature (190)..(278): Pfam Name: 2OG-FeII_Oxy Pfam Description: 2OG-Fe(II) oxygenase superfamily
  misc_feature (1)..(319): Functional Homolog Of SEQ ID NO. 471
MSVNIPCLDLNDFVNGSPEQRKKFSDEIGKAFNETGFVTIKNHGLSPELIDALYVQVKSIFGLPEEVKKGYEKVELAGQRGYTSKGREQAKGAKTPDLKEFWQIGQYVEGETLSKEDYPDNLEVSELPQFNTITKEVYKKLEVAGTQLLKAIAAYLGLNETYFDQKVWNGNSILRCIHYFPIEDPDSIPADAVRAGAHEDINLITLLIGASADGLEVLTRDGSWFPIKAGQQDIVVNVGDMLQRLTNGKLVSTTHRVVNPPRELMKTSRFSVPFFLHPKSAMDLTSLDSCIDAQHPKQFSDMTAGEYLDERLREIGLKK

SEQ ID NO: 960 - protein, 345 aa, Cryptococcus gattii WM276
  misc_feature (1)..(345): Public GI ID no. 321253745
  misc_feature (1)..(345): Bit score of 101.4 for HMM based on sequences of FIGURE 1.
  misc_feature (201)..(300): Pfam Name: 2OG-FeII_Oxy Pfam Description: 2OG-Fe(II) oxygenase superfamily
  misc_feature (1)..(345): Functional Homolog Of SEQ ID NO. 471
MVNLADLSSSLASQDFTSIPVIDLSDAQSPSLQKRKAVAAEIRNACLNAGFFYVKNHGVPLQVVDRTFEQSKEFFNQPNELKKSVDISKSGGNFRGYMGLLSENNDPKNKGDMHEAFNMGLDPSVDASAFVQDVKEGELRHSENLWPDKKDWQGADDFKQANLDYYKEVLRLGQSLFPLFALALDLPEDFFDDKIKHPAAIMRILFYPALGERQVDELMPGIGAHTDFECFTILRQDDVPSALQVQNRKGQWIDAPYMPDTFVINIGDQFARWTNDIFVSTRHRVLPALSKDRYSIPFFFGCDHDVPLIPPETCVTPDRPAKYETMTAGAYVHMRLSDIYKVKET

SEQ ID NO: 961 - protein, 405 aa, Sporisorium reilianum SRZ2
  misc_feature (1)..(405): Public GI ID no. 343425662
  misc_feature (1)..(405): Bit score of 100.6 for HMM based on sequences of FIGURE 1.
  misc_feature (255)..(367): Pfam Name: 2OG-FeII_Oxy Pfam Description: 2OG-Fe(II) oxygenase superfamily
  misc_feature (1)..(405): Functional Homolog Of SEQ ID NO. 471
MTVHNLTPIVRSVARARGPSALAAAASRSALPSRAIQTRAAAASTRLSPNAIPTSSSSPARRIPAWSRSLATQTTTPDFVIPVIDFSAFVRPDATDADRARTSQQLTQAFKSSGFAYLSNHGISTEQIDATFAKSAEFFKLPFDKKDELAWKDPRANRGYVAEGRERVTQATSAEEIAALREQAPDYKESLEIGNDHDPVWKNEWPHERDAPEFKHTMLAFQKAAHELHMKVMSSIAIGLGLDARFFNDKCDEQWHTLRLLHYPSVKTDKLKVEGSARAGEHSDYGSITLLFQDSVGGLEAKNPHTGVYHAADPIPGTIVVNVGDLLARWSNDQLRSTLHRVKAPQAVDANAEYTPTRYSIAFFCNPNENQLIESLPNFDSKEGSKYDRILTKDYLAKRLSETYA

SEQ ID NO: 962 - protein, 348 aa, Paracoccidioides brasiliensis Pb18
  misc_feature (1)..(348): Public GI ID no. 226294156
  misc_feature (1)..(348): Bit score of 90.8 for HMM based on sequences of FIGURE 1.
  misc_feature (195)..(309): Pfam Name: 2OG-FeII_Oxy Pfam Description: 2OG-Fe(II) oxygenase superfamily
  misc_feature (1)..(348): Functional Homolog Of SEQ ID NO. 471
MSLLQECDPTSEGVSKDNLVIPVIDFEHYLTGTPADKHAVGMSVIKAFKTSGFLYLKNHGIPPSVVKTVFNTSAEFFARPQSEKDSLAWTTPQSNRGYVARGREKVTQSFDKDEIKKMRDTIPDLKETIEIGREGEDGFPNQWPDKIDDKGKEFTDVMKKFFMTCQDLNIKVMRAVALGMCLPEHYFDGFIDVGDNTLRLLHYPSVPKSVFRANKGQVRAGEHSDYGTITLLFQDSRGGLQVRSPQGTFIDAVPIADTIVVNAGDLLARWANDQIKSTLHRVVEPLPRQDSEDSDEYPSRYSVAYFCNPNYDKFIDAIPGTFGGDLGEKKYEGINSGEYLQYRLAMTY

SEQ ID NO: 963 - protein, 336 aa, Aspergillus oryzae 3.042
  misc_feature (1)..(336): Public GI ID no. 169768582
  misc_feature (1)..(336): Bit score of 62.6 for HMM based on sequences of FIGURE 1.
  misc_feature (169)..(256): Pfam Name: 2OG-FeII_Oxy Pfam Description: 2OG-Fe(II) oxygenase superfamily
  misc_feature (1)..(336): Functional Homolog Of SEQ ID NO. 471
MSTPIFPVIDYSRIISSNPMIAAQEKDKLFQSFKDVGFIYLKGFNFPPEFIDTLFSHLHKFFSLPEEQKLAIEGGEKQAFRGWFAPARTAKNPEKADQKEAFGLGNDKDETRPNRWPSNWPEFRRDFTTFYEECYKMHLELLRALTEKVGLDRESLIPSVKAKDCYSALLHYYETSLESFDTRVRSAPHTDFGTLTLLFNDSNGGLQVKNQEGQWVDAPPMRGHAIVNVGDLLSRWFNGQLKSTQHRVVQPPAETRETENGTTTVIPSRYAIAWFGHPNRDAVVEPLKECVTAEWTQKFKAVVAGKHVKERMARLLEHGYLPEKWTDDMHRKPIAV

SEQ ID NO: 964 - protein, 330 aa, Campylobacter jejuni subsp. jejuni 87459
  misc_feature (1)..(330): Public GI ID no. 380602393
  misc_feature (1)..(330): Bit score of 79.4 for HMM based on sequences of FIGURE 1.
  misc_feature (170)..(264): Pfam Name: 2OG-FeII_Oxy Pfam Description: 2OG-Fe(II) oxygenase superfamily
  misc_feature (1)..(330): Functional Homolog Of SEQ ID NO. 471
MNLPILDLQAYEKDKSTFLKNLREIASKIGFFYLINTSIDKNLNEKLFKLGKEFFNLSRSSKELISMVHSPQFRGYTSEGFEYTAGSKDYIEQLDIGTERDALNWNLNSPLWQRLEGPNLWPSEIPELKKTFLTWHKQTKKACLKLLKAFAQALDLPSNAFDKLYGKNSYEHCKIIHYPKSSKNTTQGVGSHKDGGLITFVFQEKQSGLEAFIDGKWLSIPPLENSVVVNIGEFLELATNGYLKATIHRVNLSPKERFSIAYFLGVQLDKDIPIFKLNPELAKESKGVDTDPKNPLLRNVASNYFKRMIRSHPDVASIYHSDLIEKFSFA

SEQ ID NO: 965 - protein, 340 aa, Arthroderma gypseum CBS 118893
  misc_feature (1)..(340): Public GI ID no. 315044917
  misc_feature (1)..(340): Bit score of 54.7 for HMM based on sequences of FIGURE 1.
  misc_feature (177)..(301): Pfam Name: 2OG-FeII_Oxy Pfam Description: 2OG-Fe(II) oxygenase superfamily
  misc_feature (1)..(340): Functional Homolog Of SEQ ID NO. 471
MSQIPVVDFAPFRRGSAEDAKATGKKIFEAFRDVGFVYLKNHGVPQEVVDEAFSWSKKLFDLPQSEKEKAPHPPEGWWHRGYSGVGREKLSQMVFDRDAVGELRKIPDVKESFEMGREDDESIPNIWLPESTIPGFRAFFNSFYEINHGVGQEILCAVAIGMGLERDFFESYHTMKDNQIRLLHYPPVEEEMLLQGKKERIAAHTDFATMTLLFQDDVGGLEVEDVHQKGVFNPVPYIPGTIVVNIGDFLMRWSNDTLRSTMHRVRAPPAAKVDGNGKEEDEGSSAQRMSRARYSIPYFIAANKEKVIDCLPGCYGPERPKKYKPITSGEYVAMRLNAIS

SEQ ID NO: 966 - protein, 339 aa, Hylemonella gracilis ATCC 19624
  misc_feature (1)..(339): Public GI ID no. 332529892
  misc_feature (1)..(339): Bit score of 43.7 for HMM based on sequences of FIGURE 1.
  misc_feature (62)..(78): Pfam Name: 2OG-FeII_Oxy Pfam Description: 2OG-Fe(II) oxygenase superfamily
  misc_feature (1)..(339): Functional Homolog Of SEQ ID NO. 471
MKFNFQEICMTAPAYDLTELQKESRMGAMGTLDTAREIRRIDLSNFEARKAEIADQLWDAAVDVGFFQLVNHGIRPQEIQAAFAMAERFFALPESVKQQYPHKKALNVGWESRAQVRPSTGTPDQKESYQITRPHMADLWPTEAELPGFQATMLAFERKSWGVGMQVLSCFAHKLGFADDFFTRAHDPEHADYQSTLRLLHYYAIPPEVQDKLDLWRAGAHTDFDCLTLLYQRQGQGGLEVCPGKEMDAQAWTPIPPDGDAITCNIGDMLMRWSDDRLPSNFHRVRNPQPGEYMGPRYSLAFFAQANRSALIEGPARKYPAISAGDYLKQRVAANFKAY

SEQ ID NO: 967 - protein, 332 aa, Ralstonia eutropha H16
  misc_feature (1)..(332): Public GI ID no. 116695054
  misc_feature (1)..(332): Bit score of 64.8 for HMM based on sequences of FIGURE 1.
  misc_feature (190)..(298): Pfam Name: 2OG-FeII_Oxy Pfam Description: 2OG-Fe(II) oxygenase superfamily
  misc_feature (1)..(332): Functional Homolog Of SEQ ID NO. 471
MSQPDTAYALAELHRESRMGAFGSETRQREIRRIDLSDYARRKAQIADELWQASVDVGFFQIANHGIDLTSVREAFAMTERFFALPDAVKAQYPLQKANNAGWESRAQVRPSTGTPDQKESYQITRPHMAGLWPGDDELEGFRATMLAFEAQCWEVGMKVLSCFAGKLGFASDFFTQAHDPRAPDYQSTLRLLHYYAIPPELRDKLELWRAGAHTDFDCLTLLFQRPGQGGLQVCPGKEMEAQAWTPIEPDEEVITCNIGDMLMRWSDDRLPSNFHRVRNPAPDEYMGPRYSMAFFCQANRGAMIEGPGGKYPPISAGDYLRQRVNANFKGY

SEQ ID NO: 968 - protein, 312 aa, Verticillium dahliae VdLs.17
  misc_feature (1)..(312): Public GI ID no. 346974225
  misc_feature (1)..(312): Bit score of 37.9 for HMM based on sequences of FIGURE 1.
  misc_feature (133)..(251): Pfam Name: 2OG-FeII_Oxy Pfam Description: 2OG-Fe(II) oxygenase superfamily
  misc_feature (1)..(312): Functional Homolog Of SEQ ID NO. 471
MAPNANIPIIDVSKAVDEADVARRVVDAAAEHGFIYIKNTGDFIGLSDIDGAFDLVGDYKEAFNFGEFADGKAQQPLPATIQPDEPQVNSFREQCHSLCLRLLYLLGLGLDVSPPDFFSSAHLPSRGSSGTILRLLYYPATSASNAAPDAVRAGAHSDYGSITLLFRLEGQAGLEILTRENAWAPVPVRPPGTEDDALPPILVNIGDLLSYWTNGLFRSTVHRVVFSGDAAPVEGESDTGPRYSIAFFCHPVGATALEPVPTDRVKTFNPEAGTPNANPYAERKVVTADEHLHMRLKESYKDLYKEEEQAKA

SEQ ID NO: 969 - protein, 194 aa, Glarea lozoyensis 74030
  misc_feature (1)..(194): Public GI ID no. 361126689
  misc_feature (1)..(194): Bit score of 44.4 for HMM based on sequences of FIGURE 1.
  misc_feature (69)..(159): Pfam Name: 2OG-FeII_Oxy Pfam Description: 2OG-Fe(II) oxygenase superfamily
  misc_feature (1)..(194): Functional Homolog Of SEQ ID NO. 471
MDEKEKNNYDIDTIAPWKLHGHTPAGRNSGLAGAGEKHGVEAYTIRAETVWEVVRASLHRNTGRLSLQRLAYYLSGLAPHTDVGSLTVLFADKRGLQARHPDTGEWQYLEPREGCAVINIGDSLRFMSQKNFQSALHRVIPTPGTTIHDRFSCAYFLRPELDAEFDAEGQHWKSIDWHLRKYKSYRSGQTGKTE

SEQ ID NO: 970 - protein, 368 aa, Paracoccidioides brasiliensis Pb18
  misc_feature (1)..(368): Public GI ID no. 226292680
  misc_feature (1)..(368): Bit score of 44.9 for HMM based on sequences of FIGURE 1.
  misc_feature (192)..(327): Pfam Name: 2OG-FeII_Oxy Pfam Description: 2OG-Fe(II) oxygenase superfamily
  misc_feature (1)..(368): Functional Homolog Of SEQ ID NO. 471
MATTFCSLPIVDLTPLKNPNGLRKEEQKSLANQLYDVFVTTGFAYLVNYPLNFDHETLFDITREFFALPIEEKMKLSKRSFCKDNLNTYRGYFPTQPDLANDNLKEGFEIGPKHHCPQSSISNGSTNPGNLKVNLSEPNVWLAPTIFPFRFKLEQLHSELQSLASTLLSLFAIALNKEADFFSPYLTDSLSTLRLLHYPPNANPKLNPSILQQETSPDADSDSDTVKLCCPPHTDSGILTLLHQDATGGLEVQDSDGKWIAAPYVPGSIVVNIGDLMAKVSGGRFVATMHRVRAPPATASSPSPGADDGMQQGLGMGRFSVPFFFEPGEECAVRSVDDDIDGGGGTGALVYGDHVKAKMKTWVEFQGL

SEQ ID NO: 971 - protein, 355 aa, Neosartorya fischeri NRRL 181
  misc_feature (1)..(355): Public GI ID no. 119478814
  misc_feature (1)..(355): Bit score of 87.1 for HMM based on sequences of FIGURE 1.
  misc_feature (36)..(68): Pfam Name: 2OG-FeII_Oxy Pfam Description: 2OG-Fe(II) oxygenase superfamily
  misc_feature (1)..(355): Functional Homolog Of SEQ ID NO. 471
MDDNLAQHACHPITTAIEKDDLVIPVIDFGPFLRGTPSDKHAVAVSITDAFKTSGFLYLKDHGIPFSTVSQVFETSARFFARPQDQKDSLCWTSPQSNRGYVKTGREKLSLPEDNVDKDTARLATPDLKETMEIGRDDVDGLPNRWPDHFDDEGKDFKKAMQSFFAMCKSLHTEVMRAIALGMNLPEHYFDEFVDAGDNNLRLLHYPSVPKDVFKKNAGQVRAAEHSDYGSITLLFQDRRGGLQVRSPKGTFVDATPIADTVVVNAGDLLARWSNDIIKSTRHRVVEPPSIAGVDADDGSDTYPARYSIAYFCNPNMNKFIDALPGTFGEEISQKKKYPGITAGDYLVQRLTATI

SEQ ID NO: 972 - protein, 344 aa, Botryotinia fuckeliana
  misc_feature (1)..(344): Public GI ID no. 347829892
  misc_feature (1)..(344): Bit score of 45.2 for HMM based on sequences of FIGURE 1.
  misc_feature (185)..(303): Pfam Name: 2OG-FeII_Oxy Pfam Description: 2OG-Fe(II) oxygenase superfamily
  misc_feature (1)..(344): Functional Homolog Of SEQ ID NO. 471
MSSSPTSAIPIIDFAPFLHPTSPTSRLETAKALVNACRHFGFVYIINHGVPSSLLEEAFGITKQLFDLSHEAKMQAPHPPGMSVHRGYSYPGLEKVYQVIGDNTELGEKMRGVKNCKESYEIGSEENPSQPNIWLPESTLPNFHSFMQSFYHRLSTTAQMILLALGTGLEIHSPSLLADFHSGHTNQLRLLHYPPIPASEIETGLAVRLPAHTDFGTITLVFQDECGGLEIEHPKKPGEFIRADPVKDAIVMNIGDLLMRWTNDDLKSSLHRVQLPPSTSRYTITEEGERMTQARYSIPYFCGPDTDKSIEVLEECVKEGEKKKYEPIVVGEYFKMRSAFAYQS

SEQ ID NO: 973 - protein, 361 aa, Scheffersomyces stipitis CBS 6054
  misc_feature (1)..(361): Public GI ID no. 150951140
  misc_feature (1)..(361): Bit score of 74.3 for HMM based on sequences of FIGURE 1.
  misc_feature (191)..(296): Pfam Name: 2OG-FeII_Oxy Pfam Description: 2OG-Fe(II) oxygenase superfamily
  misc_feature (1)..(361): Functional Homolog Of SEQ ID NO. 471
MTVSSNIRPWQSPEETQEDLDWANLTIIDLAHFDEPGQKQILANQLKEASNSDGFWAVINGGFDQNDINEAFAYGRSFFEDYTEEEKKALEVDFTTGNYFGYKVRGNKPVFGTQVRDNTETLNIAKFTKDDTFAEYHKNNFIQNNHDKLAQLSRKVFEVARKLFILFAIILELDENYFVDRHLYDDPSDDSLRFMKYHPRTKEEDAQVENIWARAHTDFGSLTLLFNQVVAGLQIKLADGEWKYVKPVTGGLICNIGDTLNFWSGGYFKTTIHRVVRPPEDQVNAPRIGAFYFVRPGDKAQIQIAPSPLLKRLGLYRETEPIGGTEYVRKRVKDYHDVKGYNKQADKVFKLGEFEVIDGFN

SEQ ID NO: 974 - protein, 373 aa, Lodderomyces elongisporus NRRL YB-4239
  misc_feature (1)..(373): Public GI ID no. 149245084
  misc_feature (1)..(373): Bit score of 46.6 for HMM based on sequences of FIGURE 1.
  misc_feature (181)..(291): Pfam Name: 2OG-FeII_Oxy Pfam Description: 2OG-Fe(II) oxygenase superfamily
  misc_feature (1)..(373): Functional Homolog Of SEQ ID NO. 471
MSFQDIPILDLNDAFNAETKPQFLSKLRNAMINVGFLLLKNYESIGPTREELVAIKEQSELFFALPDEIKLKIEMINSPHFLGYTRLANEITASHTDWREQIDLGTELPAPKEGEPIYKNIEGPNLWPDEAAIPNFRQVVENYIAKMTALSTTFRYLVLESIGLQGEALNDYFKPNQQCKMKLIAYPDSTSLTNATSVALKDTPTTGQGVGPHRDSDLITYIYQATDHQDSLEVQNFQGKWIPVPNIPNHLVVNNGQTLEAITQGVCKATIHRVLIPKPGSGTRISVPFFQTIDLDSSKSAVQNIPDDILRLREERDKRIKDWAVDMGFQFKPDVSKEPVGYAVFRNRIKSHQDVAKRWYPEILKQVLLEYSY

SEQ ID NO: 975 - protein, 269 aa, Sclerotinia sclerotiorum 1980 UF-70
  misc_feature (1)..(269): Public GI ID no. 156064337
  misc_feature (1)..(269): Bit score of 45.0 for HMM based on sequences of FIGURE 1.
  misc_feature (169)..(264): Pfam Name: 2OG-FeII_Oxy Pfam Description: 2OG-Fe(II) oxygenase superfamily
  misc_feature (1)..(269): Functional Homolog Of SEQ ID NO. 471
MTSQSNSQDSAQGLPNTDLQGLFDRDPAEATKLLDASKQYGFFYLDFRTISKSKTVLSLINQIYRFEEELFSLPQDYLMKYDVDEIGYMKLNGYKPKGRNFGHGVLGLSDEPYYRPPIFDENMPMLKAYMLAMQEATASIHDALSRALGLQVGRRLEEFHRPDRASPCILRLLKYHPQPAEERGASGTPHTDLGSLTILFTKQPGLQVLRKGCDKWEYVEPRAGHAIMNIGDGMSLLTNGLLHSSLHRVAPPPGQAVTTRYSFASTQIL

SEQ ID NO: 976 - protein, 373 aa, Talaromyces stipitatus ATCC 10500
  misc_feature (1)..(373): Public GI ID no. 242780807
  misc_feature (1)..(373): Bit score of 42.5 for HMM based on sequences of FIGURE 1.
  misc_feature (188)..(277): Pfam Name: 2OG-FeII_Oxy Pfam Description: 2OG-Fe(II) oxygenase superfamily
  misc_feature (1)..(373): Functional Homolog Of SEQ ID NO. 471
MPDTSLEKYDHVPVTKEDLDWAELVTLDLSLYDQPGGKEKLVKQLEHAVQHVGFFYVKNFNISQEEVDFQFALGREFYALPLEEKLKYHNADDLARGEYNGYRPAGHRILGNGIRDNVQVYNIPKFDGYHQRAQPDVLQKYATEIEAFSRKCHTEVVEKLLRLFAILLELPDEDQLVRDHKYDVKGEDHLRYMHYAARSAEDNKKVGELYSPGHTDLGTITLLFRQPVVALQILNSEGQWKWVRPQDGTITINTCDALTALTGGFIKSSIHRVHAPPQDQAHVDRLGVLYFARPNNHVILDPIQNSPLLNHLGLTKNAFTELDQHLTTEQWVKVRQSQQQRRNRDVKISDDGKYTYKHKDLEIIPGLQAVVYN

SEQ ID NO: 977 - DNA, 1700 bp, Panicum virgatum
  misc_feature (1)..(1700): Ceres Clone ID no. 1787734
  misc_feature (1)..(1700): Encodes the peptide sequence at SEQ ID NO. 978
acacttttctcctcctcataccactaatgcaaggtcctatatttacacttcttggtgcttgcttagcttgtttctttctagcaacgataattgccatagcagctagctgctggtagtgatctattggccggccggccatgatcgggggtcagcgagtgagtactactagctagctagctcataagcaagcagcaggcaaggccggccggagatgccgacgccgtcgcacctcaagaacccgctctacttcgacttccgcgccgcgcggcgcgtgccggagtcgcacgcctggccggcgctgcacgaccaccccgtcgtggacggcggcggcgcgccggggacgccggacgccgtgccggtggtggacctgcgggagcccggcgcggcggcggcggccggcgtggcgcgcgccgccgagcagtggggcgcgttcctgctcaccggccacggcgtccccgccgagctcctggcgcgcgtcgaggaccgcatcgcgtgcctgttcgcgctgccggccgccgacaagatgcgcgcctcgcgcgggcccggggacgcctgcggctacggctcgccgatcatcgcctccttcttctccaagtgcatgtggtccgagggctacaccttctcgccggcctccctccgcgacgacctccgcaagctctggcccaaggccggcgacgactacgccatcttctgcgacgtgatggaggagttccacaaggagatgcacgtcctggcgggcaagctgctggagctgttcctcagggcgctcgggctcaccgacgagcaggtcgccgccgtcgaggaggaccggaggatcggcgagaccatgaccgccaccatgcacctcaactggtatccgaggtgcccggacccgcggcgcgcgctggggctgatcgcgcacacggactcgggcttcttcaccttcgtgctgcagagcctcgtgccggggctgcagctcttccggcacgccccgaatcggtgggtggcggtgccggccgtgccgggcgccttcgtcgtcaacgtcggcgacctcttccagatcctcaccaacggccgcttccacagcgtctaccaccgcgccgtcgtgaaccgggacctcgaccggatatcgctcggctacttcctcggcccgccgccgcacaccaaggtggcgccgctgcgggaggccgtgccgccgggcaggacccccgcgtaccgcgccgtcacgtggcccgagtacatgggcgtccgcgagaaggccttcgccaccggcgcctccgcgctcaaaatggtcgccaccgccgccgaatccgacgatgccgacgccgacgtccaccagccgccgctcgtcctctcgtcgtagccgatctcgatcgatcgccggagacacagacgacggcgcataccgtacccccgatcaaactaatcaaacacgccgccgcgcgcaaccccgatgaaatggcatcttccattctcgctcgcgcgcatgcagcggccggccttccgcacctgctcgtcctcctctgtcggctgttagaaaaaaaaaactaatctgagacgaagacaaagacgaaacgaacgaagaggaagaggacatgctgtagctgtttcttctagttgcaggcaggctgctgctcccagccgagtttgtcgttactgacgattattatcctgattgaaaactaatctgaattaatgcatgtggtttggcatttggtact

SEQ ID NO: 978 - protein, 376 aa, Panicum virgatum
  misc_feature (1)..(376): Ceres Clone ID no. 1787734
  misc_feature (1)..(376): Bit score of 578.7 for HMM based on sequences of FIGURE 4.
  misc_feature (210)..(307): Pfam Name: 2OG-FeII_Oxy Pfam Description: 2OG-Fe(II) oxygenase superfamily
  misc_feature (1)..(376): Functional Homolog Of SEQ ID NO. 1
MPTPSHLKNPLYFDFRAARRVPESHAWPALHDHPVVDGGGAPGTPDAVPVVDLREPGAAAAAGVARAAEQWGAFLLTGHGVPAELLARVEDRIACLFALPAADKMRASRGPGDACGYGSPIIASFFSKCMWSEGYTFSPASLRDDLRKLWPKAGDDYAIFCDVMEEFHKEMHVLAGKLLELFLRALGLTDEQVAAVEEDRRIGETMTATMHLNWYPRCPDPRRALGLIAHTDSGFFTFVLQSLVPGLQLFRHAPNRWVAVPAVPGAFVVNVGDLFQILTNGRFHSVYHRAVVNRDLDRISLGYFLGPPPHTKVAPLREAVPPGRTPAYRAVTWPEYMGVREKAFATGASALKMVATAAESDDADADVHQPPLVLSS

SEQ ID NO: 979 - DNA, 1142 bp, Triticum aestivum
  misc_feature (1)..(1142): Ceres Clone ID no. 704370
  misc_feature (1)..(1142): Encodes the peptide sequence at SEQ ID NO. 980
atgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtagatcggcgccggccatcaccggccggccaagggatcgatctacacacacaattagtgaacaaaaaaatgccagagatggtgcatggtgggctggtagcttagctgaggtagctaggaggaagagcgcgcgtgcggctgtcgttcgtgcggctgttcccgcaaaaaaaaaaaggtttcctccatatatgtctccatgcagaactgcagatgctggtggtggatgcgtccatgcagcagggaacgaactaattgtaagaaaatcaagcaaacttagttctacatctgtaattaagtatgcatgccacttggttt

SEQ ID NO: 980 - protein, 276 aa, Triticum aestivum
  misc_feature (1)..(276): Ceres Clone ID no. 704370
  misc_feature (1)..(276): Bit score of 476.4 for HMM based on sequences of FIGURE 4.
  misc_feature (115)..(212): Pfam Name: 2OG-FeII_Oxy Pfam Description: 2OG-Fe(II) oxygenase superfamily
  misc_feature (1)..(276): Functional Homolog Of SEQ ID NO. 1
MFALPASEKMRAVRRPGDSCGYGSPPISSFFSKCMWSEGYTFSPANLRSDLRKLWPKAGHDYRHFCAVMEEFHREMRALADKLLELFLVALGLTGEQVAAVESEQKIAETMTATMHLNWYPKCPDPKRALGLIAHTDSGFFTFVLQSLVPGLQLFRHGPDRWVTVPAVPGAMVVNVGDLFQILTNGRFHSVYHRAVVNRDSDRISLGYFLGPPAHVKVAPLREALAGTPAAYRAVTWPEYMGVRKKAFTTGASALKMVAISTDNDAANHTDDLISS

SEQ ID NO: 981 - protein, 385 aa, Brachypodium distachyon
  misc_feature (1)..(385): Public GI ID no. 357136088
  misc_feature (1)..(385): Bit score of 535.9 for HMM based on sequences of FIGURE 4.
  misc_feature (216)..(311): Pfam Name: 2OG-FeII_Oxy Pfam Description: 2OG-Fe(II) oxygenase superfamily
  misc_feature (1)..(385): Functional Homolog Of SEQ ID NO. 1
MPTASHLTSPRYFDFRAARGVPESHAWPGLHDHPVVDGGAGAGAGEDDADRVPVVDMRADPSAAAAAVARAAETWGAFLLEGHGVPESLLARVEERVAGMFALPAPEKMRAVRGRGESCGYGSPPISSFFAKSMWSEGYTFSPAHLRRDLRKLWPKAGPDYLLFCEVMEEFHREMRLLADKLLGLFLRALGLTADEALAVEATHRIAETMTATTHLNWYPRCPDPKRALGLIPHTDSGYFTFVLQSQVPGLQLFRRGPDRWVAVPAVPGAFVVNVGDLFSILTNGRFHSVFHRAVVNKESHRVSLGYFLGPPAQTRVGPLEEALTPARPKPMYRPVTWPEYMTVRKKAFATGDSALQMVAVDQDDDDDAQTKLANRKIKVSGEAY

SEQ ID NO: 982 - protein, 377 aa, Hordeum vulgare subsp. vulgare
  misc_feature (1)..(377): Public GI ID no. 326502098
  misc_feature (1)..(377): Bit score of 497.5 for HMM based on sequences of FIGURE 4.
  misc_feature (206)..(307): Pfam Name: 2OG-FeII_Oxy Pfam Description: 2OG-Fe(II) oxygenase superfamily
  misc_feature (1)..(377): Functional Homolog Of SEQ ID NO. 1
MPSQLNKDPHNRYFDLGAAREVPDTHAWDGQHELPVVDGGVGAGDDAVPVVDMRDPRAAEAVARASEQWGAFLLEGHGVPTELLARVEAGIAGMFALPTPEKMRAARHDGDLYGYGPPLIASYVSKNMWSEGYTLTPANLHAEFRKIWPDAGQHYRHFSGVMEEFLKEMRSLANRLMELFLVALGLTAEQIAGVEAEHNLTESMTETMHLNWYPKCPDPTRALGLKGHTDSGFFTFVMQNQVPGLHLFRHGPPADRWVEVPAVPGALIVNIGDLFQILTNGRFRSVYHRVVVNRERERISVAYFLIPPADVKVAPLKEVVGGGKPVYRALTWSESIVVRKEAFANHGADLEFGKGRTALDMLSISSDEDDGAEHHRD

SEQ ID NO: 983 - protein, 363 aa, Brachypodium distachyon
  misc_feature (1)..(363): Public GI ID no. 357152716
  misc_feature (1)..(363): Bit score of 487.6 for HMM based on sequences of FIGURE 4.
  misc_feature (200)..(298): Pfam Name: 2OG-FeII_Oxy Pfam Description: 2OG-Fe(II) oxygenase superfamily
  misc_feature (1)..(363): Functional Homolog Of SEQ ID NO. 1
MPTATHLDFQAARGVPETHEWPVLHDHPVVDGGAGAGEDEVPVVDLRDADPAKVAAAMARAAEQWGAFLLLGHGVPADLVARVEERIEAMFALPASEKTRAVRGRGESCGYGSPPISGFFDKSMWSEGYTFAPANVRLDLLKLWPDAGPHYLLFCEVMEEFHKGMFALAHKLLGLFLSALGLTAADCAAAAKIADTMAASMHLNWYPKCPDPKRAVGLIAHTDSGYFTFVLQSMVPGLQLFRREPDRWVAVPAMRGAFVINVGDLFNIVTNGRFHNVFHRAVVSRESHRVSLGYFLGPPAQAVVAPLDEALTLDRPRPAYRPVVWREYMGLREKALFVGESALKMIAVAKDDAPQTPKLHETS

SEQ ID NO: 984 - protein, 394 aa, Sorghum bicolor
  misc_feature (1)..(394): Public GI ID no. 242089739
  misc_feature (1)..(394): Bit score of 458.8 for HMM based on sequences of FIGURE 4.
  misc_feature (232)..(325): Pfam Name: 2OG-FeII_Oxy Pfam Description: 2OG-Fe(II) oxygenase superfamily
  misc_feature (1)..(394): Functional Homolog Of SEQ ID NO. 1
MMPSSSSSASTPAAASGGLFELGSAASVPETHAWPGVNEHPSVESAGRDAVPVVDMGMGGPDDADAAARAVARAAEEWGAFLLVGHGVPRGVAARAEAQVARLFALPAPDKARAARRRRAAAAAAAGYGMPPLALRFSKLMWSEAYTFPAAAVRDEFRRVWPDAGDDYLRFCDVMEEYDREMRALGGRLLDLFFMALGGGLTDDDQIAGGETTTTERKIRDNLTAMMHPILYPKCPEPERAMGLAPHTDSGFITLITQSAGVPGLQLLRRGPDRWVTVPAPPGAFVVVLGDLFQVLTNGRYRSALHRAVVNRERDRISVPYFLGPPDGMKVAPLASALLPGRRKAAFRAVTWPEYMELKHKVLGTDTSALEMLQLDEEEMVAARPRNVQLTLLS

SEQ ID NO: 985 - protein, 359 aa, Vitis vinifera
  misc_feature (1)..(359): Public GI ID no. 225442751
  misc_feature (1)..(359): Bit score of 534.5 for HMM based on sequences of FIGURE 4.
  misc_feature (207)..(304): Pfam Name: 2OG-FeII_Oxy Pfam Description: 2OG-Fe(II) oxygenase superfamily
  misc_feature (1)..(359): Functional Homolog Of SEQ ID NO. 1
MPSELSDAFKSMPANLYKKQLDLNSIQELPDSHAWASLGEHPCVDSLIAESVPVIDLSDPNALTLVGDACKSWGVFQVINHGIPISLLEAIEDASRNLFALPAEQKLKATRPPDGFSGFGQPRIAPFFAKQMWYEGFTVLGSPLELVSKLWPEEYCTKFCEVTEEYDKQMKQLANKLLWLLLGSLGINKEDVEWAGPEGQLEGAHAALQLNSYPACPQPDKAMGLAEHTDSSLLTILYQGSTSGLQVVLEGSGWITVPPLPGALVVNIGDLLHILSNAAFPSVLHRAMVNNSKQRISVAYFYGPPATIPVAPIPKLVDSSHPPVYRSVTWSEFLATKAKHFNKALSLVRMPVPETDSSE

SEQ ID NO: 986 - protein, 371 aa, Medicago truncatula
  misc_feature (1)..(371): Public GI ID no. 357455059
  misc_feature (1)..(371): Bit score of 603.0 for HMM based on sequences of FIGURE 4.
  misc_feature (207)..(303): Pfam Name: 2OG-FeII_Oxy Pfam Description: 2OG-Fe(II) oxygenase superfamily
  misc_feature (1)..(371): Functional Homolog Of SEQ ID NO. 1
MPSLSEAYRAHPVHVNHKHPDFNSLQELPESYTWNHLDDHTLIKEGTTSSIVPVIDLNDPNASKLIGHACKTWGVYQVVNHGIPISLLDEIQWLGQTLFTLPSHQKLKAIRSPDGVSGYGLARISSFFPKLMWSEGFTIVGSPLDHFQQLWPQDYAKHCDTVLQYDEAMKKLAGKLMWLMLDSLGITMEDIKWAGSKAQFDEKACAAMQLNSYPSCPDPDHAMGLAPHTDSTFLTILSQNDISGLQVQREGSGWVTVPPLHGGLVVNVGDLFHILSNGLYTSVLHRVLVNRTRQRFSVAYLYGPPSNVEICPHEKLVGPTQPPLYRSVTWNEYLGTKAKYFNKALSSVSLCAPINGLFDVNDSNKSSVQVG

SEQ ID NO: 987 - protein, 368 aa, Castanea mollissima
  misc_feature (1)..(368): Public GI ID no. 365176184
  misc_feature (1)..(368): Bit score of 608.5 for HMM based on sequences of FIGURE 4.
  misc_feature (206)..(302): Pfam Name: 2OG-FeII_Oxy Pfam Description: 2OG-Fe(II) oxygenase superfamily
  misc_feature (1)..(368): Functional Homolog Of SEQ ID NO. 1
MPSRLSDAFKAHPVQLYPKHQDFNSLQELPDSYKWTQLDEYPSCESFSSESVPLIDLTDPNALTLVGHACKTWGVFQVTNHGIPTKLLDDIESVSRCLFSLPQQQKLKAARSPDGVSGYGLARISSFFPKLMWSEGFTIVGSPLEHFRQLWPQEYSKFCDIIEEYEKEMKKLAGRLMWLILGSLGICNEDIKWAGPKGEFQGASAALQLNSYPACPDPDQAMGLAAHTDSTLLTILHQNNTSGLQVLREGTGWVTVDPVQGALVVNIGDLLHILSNGLYPSVLHRAMVNRTRYRLSMAYLYGPPDSVQISPLSKLLGPSHPPLYRPVTWNEYLGTKAKHFNKALSCVRLCVPLNGLVDVNDHNRVQVG

SEQ ID NO: 988 - protein, 378 aa, Glycine max
  misc_feature (1)..(378): Public GI ID no. 356522371
  misc_feature (1)..(378): Bit score of 559.4 for HMM based on sequences of FIGURE 4.
  misc_feature (210)..(305): Pfam Name: 2OG-FeII_Oxy Pfam Description: 2OG-Fe(II) oxygenase superfamily
  misc_feature (1)..(378): Functional Homolog Of SEQ ID NO. 1
MPSLSEAFRGHPVYLHHKHSDFNSLQELPDSYSWTQPHDHHLPNYPSNNKTKIFVPVIDLNHPNAPNLIGHACKTWGVFQVVNHDIPMSLFSDIQRASLALFSLPLHQKLKAARSPDGVSGYGRARISSFFPKLMWSECFTILDSPLDLFLKLWPQDYAKYCDIVVEYEAAMKKLAAKLMCLMLASLGITKEDTKWAGPKGEFNGACAALHLNSYPSCPDPDRAMGLAAHTDSTLLTILHQNNVNGLQVLKEGEGWVAVPPLHGGLVINVGDLLHILSNGLYPSVLHRVRVNRTQQRFSVAYLYGPPANVQISPHVKLVGPTRPALYRPVTWNEYLGTKANLFNKALSAVRLSASINGLFDINEDQNNDFQVGFNLDI

SEQ ID NO: 989 - protein, 352 aa, Glycine max
  misc_feature (1)..(352): Public GI ID no. 356550578
  misc_feature (1)..(352): Bit score of 567.1 for HMM based on sequences of FIGURE 4.
  misc_feature (205)..(301): Pfam Name: 2OG-FeII_Oxy Pfam Description: 2OG-Fe(II) oxygenase superfamily
  misc_feature (1)..(352): Functional Homolog Of SEQ ID NO. 1
MPSLSEAYRAHPVHVQHKHPDLNSLQELPESYTWTHHSHDDHTPAASNESVPVIDLNDPNASKLIHHACITWGAYQVVNHAIPMSLLQDIQWVGETLFSLPCHQKQKAARSPDGADGYGLARISSFFPKLMWSEGFTIVGSPLEHFRQLWPQDYHKYCDIVKRYDEAMKKLVGKLMWLMLDSLGITKEDLKWAGSKGQFKKTCAALQLNSYPTCPDPDRAMGLAAHTDSTLLTILYQNNISGLQVHRKGGGWVTVAPVPEGLVINVGDLLHILSNGLYPSVLHRVLVNRIQQRLSVAYLCGPPPNVEICPHAKLVGPNKPPLYKAVTWNEYLGTKAKHFNKALSTVRLCAPS

SEQ ID NO: 990 - protein, 359 aa, Medicago truncatula
  misc_feature (1)..(359): Public GI ID no. 357436835
  misc_feature (1)..(359): Bit score of 430.1 for HMM based on sequences of FIGURE 4.
  misc_feature (214)..(310): Pfam Name: 2OG-FeII_Oxy Pfam Description: 2OG-Fe(II) oxygenase superfamily
  misc_feature (1)..(359): Functional Homolog Of SEQ ID NO. 1
MATTLSEAYRDHPLHLHHIIPLDFSSFRTLPDSHAWPQSNDDGSDNFTSNGCYDNDDEDGSCIPIIDLNDPNAMEQIGLACEKWGAFQLKNHGIPLNFIEEVEEEAKRLFSLPSKEKLKALRSAGGGTGYGRARISPFFPKFMWHEGFTIMGSPSNDAKKIWPNDYKRFCDTMENYQKQMKTLAEKLTNMILNILGISQEQNKWIGSNNHVGAMQLNFYPCCPDPKKAMGLAPHTDTSLFTILHQSQTNGLQLFKEGVGYVPVDPHPNTLVVNTGDILHILSNSRFRCSLHRVVVNDISDRYSVAYFYGPPVDYLVSPCVGDNSLPRFRALTVKDYIGIKAKNLGGALSLISTLLDHDD

SEQ ID NO: 991 - protein, 350 aa, Glycine max
  misc_feature (1)..(350): Public GI ID no. 356563832
  misc_feature (1)..(350): Bit score of 430.3 for HMM based on sequences of FIGURE 4.
  misc_feature (207)..(305): Pfam Name: 2OG-FeII_Oxy Pfam Description: 2OG-Fe(II) oxygenase superfamily
  misc_feature (1)..(350): Functional Homolog Of SEQ ID NO. 1
MATTLSEAYRDHPLHLHHIIPLDFSSLRTLPDSHAWPQSEDGDGDDDNHGIGSPIPIIDLMDPNAMELIGLACENWGAFQLKNHGIPLSVVEEVEEEAKRLFALPADRKLKALRSATGATGYGRARISPFFPKHMWHEGFTIMGSPCDDAKKIWPNDYAPFCTIMDNYQKQMKALADKLAHMIFNLLGGISEEQKRWINGSTNNLCEAVQLNFYPRCPEPNRAMGLAPHTDTSLLTILHQSQTNGLQIFKEGAGWVPVHPHPSSLVVHTGDILHILSNSRFRCALHRVMVNSARERYSVAYFYGPPVDHVVSPLVLDSLPRFRSLTVKEYIGIKAKNLRGALSLISMLKN

SEQ ID NO: 992 - protein, 355 aa, Arabidopsis lyrata subsp. lyrata
  misc_feature (1)..(355): Public GI ID no. 297839909
  misc_feature (1)..(355): Bit score of 457.1 for HMM based on sequences of FIGURE 4.
  misc_feature (207)..(299): Pfam Name: 2OG-FeII_Oxy Pfam Description: 2OG-Fe(II) oxygenase superfamily
  misc_feature (1)..(355): Functional Homolog Of SEQ ID NO. 1
MPSLAEEICIGNLGSLQTLPDSFTWKLTAADSVLPPSSAVSSGTVEESIPVIDLSDPDVTTLIGNACKTWGAFQIANHGISQKLLDDIESLSKTLFDMPSERKLEAASSDKGVSGYGEPRISPFFEKKMWSEGFTIADASYRNHFISLWPHDHTKYCGIMEEYVDEMEKLASKLVSCILGSLGVTVEDIGWAHKLEKSGSKVGRGAIRLNHYPVCPEPERAMGLAAHTDSTILTILHQSNTGGLQVFREESGWITVEPVPGVLVVNMGDLFHILSNGKIPSVVHRAKVNHTRSRISIAYLWGGPAGEVQIAPISKLIGPVEPSLYRSITWKEYLQIKYEVFDKALDAIRVINPTN

SEQ ID NO: 993 - protein, 347 aa, Glycine max
  misc_feature (1)..(347): Public GI ID no. 356518262
  misc_feature (1)..(347): Bit score of 429.4 for HMM based on sequences of FIGURE 4.
  misc_feature (210)..(306): Pfam Name: 2OG-FeII_Oxy Pfam Description: 2OG-Fe(II) oxygenase superfamily
  misc_feature (1)..(347): Functional Homolog Of SEQ ID NO. 1
MNTTLSEAYKAHPLHLRDIIPLDFSSAHSLPDSHAWSHSQPNDDDYVSFNDDASSSSFIPIIDLMDPNAMEQIGHACEKWGAFQLKNHGIPFCVIEDVEEEAKRLFALPTEQKLKALRSPGGATGYGRARISPFFPKFMWHEGFTIIGSPSHDAKKIWPNDHAGFCDLMENYEKQMKVLAERLTQMMFSLMDISEEKTKWVGASNISGAVQLNFYPSCPEPNRAMGLAPHTDTSLFTILHQSRITGLQIFKEGKEWVPVHPHPNTLVVHTGDLLHIISNARFRSALHRVTVNSTRERYSVAYFYSPPLDYVVSPLVDSVARFRDVTVKEYIGIKAKNFGEALSLIST

SEQ ID NO: 994 - protein, 283 aa, Trigonella calliceras
  misc_feature (1)..(283): Public GI ID no. 301332976
  misc_feature (1)..(283): Bit score of 497.3 for HMM based on sequences of FIGURE 4.
  misc_feature (166)..(262): Pfam Name: 2OG-FeII_Oxy Pfam Description: 2OG-Fe(II) oxygenase superfamily
  misc_feature (1)..(283): Functional Homolog Of SEQ ID NO. 1
  misc_feature (220)..(220): Xaa is any aa, unknown, or other
MKESTTTTTNVPVIDLNDPNASKLIGHACKTWGVYQVVNHGIPLSLLDDIQWVGQTLFSLPSHEKLKAIRSPDGVSGYGLARISSFFPKLMWSEGFTIVGSPLDHFRQLWPQDHAKYCDIVLQYDEPMKKLAGKLMWLMLDSLGITKDDIKWASSKAQFEEKSCAAMQLNSYPSCPDPDRAMGLAPHTDSTFLTILSQNDISGLQVQREGLGWVTVPPLXGGLVVNVGDLFHILSNGLYTSVLHRALVNRTRQRFSVAYLYGPPSNVEICPHAKLVGPTQPPL

SEQ ID NO: 995 - protein, 282 aa, Medicago falcata
  misc_feature (1)..(282): Public GI ID no. 301332946
  misc_feature (1)..(282): Bit score of 499.3 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(282): Functional Homolog Of SEQ ID NO. 1
MKESANSSSVPIIDLNDPNASKLIGHACKTWGVYQVVNHGIPISLLDEIQWLGQTLFTLPSHQKLKAIRSPDGVSGYGLARISSFFPKLMWSEGFTIVGSPLDHFRQLWPQDYAKHCDTVLQYDEAMKKLAGKLMWLMLDSLGITMEDIEWAGSKAQFDEKACAAMQLNSYPSCPDPDHAMGLAPHTDSTFLTILSQNDISGLQVQREGSGWVTVPPLHGGLVVNVGDLFHILSNGLYTSVLHRVLVNRTRQRFSVAYLYGPPSNVEICPHEKLVGPTQPPL

SEQ ID NO: 996 - protein, 282 aa, Trigonella corniculata
  misc_feature (1)..(282): Public GI ID no. 301332982
  misc_feature (1)..(282): Bit score of 496.1 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(282): Functional Homolog Of SEQ ID NO. 1
  misc_feature (114)..(114): Xaa is any aa, unknown, or other
MKESTTSSSVPVIDLNDPNASKLIGHACKTWGVYQVVNHGIPISLLDDIHSVGQTLFSLPSNQKLKAIRSPDGVSGYGLARISSFFPKLMWSEGFTIVGSPLDHFQQLWPQDYXKYCDIVLQYDETMKKLAGKLMWLMLDSLGITKEDIKWACSKAQFDEQACAALQLNSYPSCPDPDRAMGLAPHTDSTFLTILSQNDISGLQVQQEGLGWVTVPPLHGGLVVNVGDLFHILSNGLYPSVLHRVLVNRTRQRFSVAYLYGPPSNVEICPNAKLVGPTQPPL

SEQ ID NO: 997 - protein, 282 aa, Medicago arborea
  misc_feature (1)..(282): Public GI ID no. 301332866
  misc_feature (1)..(282): Bit score of 497.1 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(282): Functional Homolog Of SEQ ID NO. 1
  misc_feature (47)..(47): Xaa is any aa, unknown, or other
  misc_feature (210)..(210): Xaa is any aa, unknown, or other
MKESANSSNVPVIDLNDPNASKLIGHACKTWGVYQVVNHGIPISLLXEIQWLGQTLFTLPSHQKLKAIRSPDGVSGYGLARISSFFPKLMWSEGFTIVGSPLDHFRQLWPQDYAKHCDTVLQYDEAMKKLAGKLMWLMLDSLGITMEDIKWAGSKAQFDEKACAAMQLNSYPSCPDPDHAMGLAPHTDSTFLTILSQNDISGLQVQREGXGWVTVPPLHGGLVVNVGDLFHILSNGLYTSVLHRVLVNRTRHRFSVAYLYGPPSKVEICPHEKLVGPTQPPH

SEQ ID NO: 998 - protein, 282 aa, Medicago brachycarpa
  misc_feature (1)..(282): Public GI ID no. 301332872
  misc_feature (1)..(282): Bit score of 496.1 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(282): Functional Homolog Of SEQ ID NO. 1
MKESANSSSVPVIDLNDPNASKLIGHACKTWGVYQVVNHGIPISLLDDIQWLGQTLFTLPSHQKLKAIRSPDGVSGYGLARISSFFPKLMWSEGFTIVGSPLDHFQQLWPQDYAKHCDTVLQYDEAMKKLAGKLMWLMLDSLGITMEDIKWAGSKAQFDEKACAAMQLNSYPSCPDPDHAMGLAPHTDSTFLTILSQNDISGLQVQREGFGWVTVPPLQGGLVVNVGDLFHILSNGLYTSVLHRVLVNRTRQRYSVAYLYGPPSNVEICPHEKLVGPTQPPH

SEQ ID NO: 999 - protein, 347 aa, Glycine max
  misc_feature (1)..(347): Public GI ID no. 356552539
  misc_feature (1)..(347): Bit score of 409.8 for HMM based on sequences of FIGURE 4.
  misc_feature (203)..(301): Pfam Name: 2OG-FeII_Oxy Pfam Description: 2OG-Fe(II) oxygenase superfamily
  misc_feature (1)..(347): Functional Homolog Of SEQ ID NO. 1
MVTTLSEAYRDHPLHLHHIIPLDFSSLRTIPDSHAWPQSEDGDDDNHGAGSCIPIIDLMDPSAMELIGLACENWGAFQLTNHGIPLSVAEGVEEEAKRLFALPADQKLKALRSAAGATGYGRARISPFFPKHMWHEGFTIMGSPCDDAKKIWHNDCARFCHIMNNYQKQMKALAEKLTHMIFNLLGNISEEQKRWIGSTNLCEAVQLNFYPCCPEPNRAMGLAPHTDTSLLTILHQSQTNGLQIFQEGAGWVPVHPHPGTLFVHTGDILHILSNSWFRCALHRVMVNSMRQRYSAAYFYAPPMDHVVSPLVLDSLPRFRSLTVKEYIGIKAKNLGGALSLISMLNNN

SEQ ID NO: 1000 - protein, 281 aa, Medicago noeana
  misc_feature (1)..(281): Public GI ID no. 301332918
  misc_feature (1)..(281): Bit score of 490.2 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(281): Functional Homolog Of SEQ ID NO. 1
MNESANSSIVPVIDLNDPNASKLIGHACKTWGVYHVVNHGIPISLLDEIQWLGQTLFTLPSHQKLKAIRSPDGVSGYGLARISSFFPKLMWSEGFTIVGSPLDHFQQLWPQDYAKHCDTVLQYDEAMKKLAGKLMWLMLDSLGIAMEDIKWAGSKAQFDEKACAAMQLNSYPSCPDPDHAMGLAPHTDSTFLTILSQNDISGLQVQQEGSGWVTVPPLHGGLVVNVGDLFHILSNGLYTSVLHRVLVNRTRQRFSVAYLYGPPSNVEICPHEKLVGPTQPP

SEQ ID NO: 1001 - protein, 286 aa, Trigonella cretica
  misc_feature (1)..(286): Public GI ID no. 301332984
  misc_feature (1)..(286): Bit score of 488.6 for HMM based on sequences of FIGURE 4.
  misc_feature (169)..(265): Pfam Name: 2OG-FeII_Oxy Pfam Description: 2OG-Fe(II) oxygenase superfamily
  misc_feature (1)..(286): Functional Homolog Of SEQ ID NO. 1
  misc_feature (89)..(89): Xaa is any aa, unknown, or other
MKESTITTTTSSSVPVIDLNDPNASKLIGHACKTWGVYQVVNHGIPISLLDDIHWLGQTLFSLPSDEKLKVIRSPDGVSGYGLARISSXFPKLMWSEGFTIVGSPLDHFRQLWPQDHAKYCDIILQYDETMKKLAGKLMWLMLDSLGITKEDIKWASSKAQFDEKASAVLQLNSYPSCPDPDRAMGLAPHTDSTFLTILSQNDISGLQVQREGFGWVTVPPLHGGLVVNIGDLFHILSNGLYPSVLHRVLVNRTRQRFSVAYLYGPPSNVEIGPHAKLVGPTQPPL

SEQ ID NO: 1002 - protein, 284 aa, Trigonella bicolor
  misc_feature (1)..(284): Public GI ID no. 301332974
  misc_feature (1)..(284): Bit score of 486.9 for HMM based on sequences of FIGURE 4.
  misc_feature (167)..(263): Pfam Name: 2OG-FeII_Oxy Pfam Description: 2OG-Fe(II) oxygenase superfamily
  misc_feature (1)..(284): Functional Homolog Of SEQ ID NO. 1
  misc_feature (94)..(94): Xaa is any aa, unknown, or other
MMKESITTSSNVPVIDLNDPNASKLIGHACKTWGVYQVVNHGIPISLLDDIQWVGQTLFSLPSQEKLKAIRPPDGVSGYGLARISSFFPKLMWXEGITIVGSPLDHFRQLWPQDYAKYCDIVLQYDETMKKLAGKLMLLMLDSLGITKEDIKWASSKAQFDENASAALQLNSYPSCPDPDHAMGLAPHTDSTFLTILSQNDISGLQVQQEGFGWVTVPPLHGGLVVNVGDLFHILSNGLYTSVLHRVLVNRTRQRFSVAYLYGPPSNVEICPHAKLVGPTQPPL

SEQ ID NO: 1003 - protein, 282 aa, Medicago lanigera
  misc_feature (1)..(282): Public GI ID no. 301332896
  misc_feature (1)..(282): Bit score of 487.1 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(282): Functional Homolog Of SEQ ID NO. 1
  misc_feature (94)..(94): Xaa is any aa, unknown, or other
MKESATTSSVPVIDLNDPNASKLIGHACKTWGVYQVVNHGIPISLLDDIQWLGETLFTLPSHQKLKAIRSPDGVSGYGLARNSSFFPKLMWSEXFTIVGSPLDHFRQLWPQDYAKYCDTVLQYDEAMKKLAGKLMWLMLDSLGITMEDIKWAGSKAQFDEKACAAMQFNSYPSCPDPDRAMGLAPHTDSTFLTILSQNDISGLQVQREGFEWVTVPPLHGGLVVNVGDLFHILSNGLYPSVLHRVLVNRTRQRFSVAYLYGPSSNVEICPHEKLVGPTQPPL

SEQ ID NO: 1004 - protein, 270 aa, Medicago marina
  misc_feature (1)..(270): Public GI ID no. 301332906
  misc_feature (1)..(270): Bit score of 476.7 for HMM based on sequences of FIGURE 4.
  misc_feature (165)..(261): Pfam Name: 2OG-FeII_Oxy Pfam Description: 2OG-Fe(II) oxygenase superfamily
  misc_feature (1)..(270): Functional Homolog Of SEQ ID NO. 1
MKESANSSSVPVIDINDPNASKLIGHACKTWGVYQVVKHGIPISLLDEIQWLGQTLFTLPSHQKLKAIRSPDGVSGYGLARISSFFPKLMWSEGFTIVESPLDHFRQLWPQDYAKHCDTVLQYDEAMKKLAGKLMWLMLDSLGITMEDIKWAGSKSQFDEKTCAAMQLNSYPSCPDPDHAMGLAPHTDSTFLTILSQNDISGLQVQREGSGWVTVSPLHGGLVVNVGDLFHILSNGLYTSVLHRVLVNRTHQRFSVAYLYGPPSNVEICP

SEQ ID NO: 1005 - protein, 264 aa, Trifolium semipilosum
  misc_feature (1)..(264): Public GI ID no. 301333008
  misc_feature (1)..(264): Bit score of 467.9 for HMM based on sequences of FIGURE 4.
  misc_feature (164)..(260): Pfam Name: 2OG-FeII_Oxy Pfam Description: 2OG-Fe(II) oxygenase superfamily
  misc_feature (1)..(264): Functional Homolog Of SEQ ID NO. 1
MKDPSSNTSVPIIDLSDPNASKLIGHACKTWGVYQVVNHGIPLSLLDDIQWVGQRLFSLPSHQKLKAIRSPDGVTGYGLARISSFFPKLMWSEGFTIVGTPLDHFQQLWPQDYAKYCDIVLQYDETMKKLAEKLMLLMLDSLGITKEDIIWANSKAQFENACAAMQLNSYPICPDPDRAMGLAPHTDSTFLTILSQSDISGLQVQREGFGWVTVPPIHGGLVVNVGDLFHILSNGLYPSVLHRVLVNRIRQRFSVAYLYGPPSN

SEQ ID NO: 1006 - protein, 350 aa, Arabidopsis thaliana
  misc_feature (1)..(350): Public GI ID no. 116831381
  misc_feature (1)..(350): Bit score of 406.0 for HMM based on sequences of FIGURE 4.
  misc_feature (206)..(305): Pfam Name: 2OG-FeII_Oxy Pfam Description: 2OG-Fe(II) oxygenase superfamily
  misc_feature (1)..(350): Functional Homolog Of SEQ ID NO. 1
MSSVTQLFKNNPVNRDRIIPLDFTNTKTLPDSHVWSKPEPETTSGPIPVISLSNPEEHGLLRQACEEWGVFHITDHGVSHSLLHNVDCQMKRLFSLPMHRKILAVRSPDESTGYGVVRISMFYDKLMWSEGFSVMGSSLRRHATLLWPDDHAEFCNVMEEYQKAMDDLSHRLISMLMGSLGLTHEDLGWLVPDKTGSGTDSIQSFLQLNSYPVCPDPHLAMGLAPHTDSSLLTILYQGNIPGLEIESPQEEGSRWIGVEPIEGSLVVIMGDLSHIISNGQFRSTMHRAVVNKTHHRVSAAYFAGPPKNLQIGPLTSDKNHPPIYRRLIWEEYLAAKATHFNKALTLFRCG

SEQ ID NO: 1007 - protein, 316 aa, Arabidopsis thaliana
  misc_feature (1)..(316): Public GI ID no. 93007346
  misc_feature (1)..(316): Bit score of 388.7 for HMM based on sequences of FIGURE 4.
  misc_feature (207)..(299): Pfam Name: 2OG-FeII_Oxy Pfam Description: 2OG-Fe(II) oxygenase superfamily
  misc_feature (1)..(316): Functional Homolog Of SEQ ID NO. 1
MPSLAEEICIGNLGSLQTLPESFTWKLTAADSLLRPSSAVSFDAVEESIPVIDLSNPDVTTLIGDASKTWGAFQIANHGISQKLLDDIESLSKTLFDMPSERKLEAASSDKGVSGYGEPRISPFFEKKMWSEGFTIADDSYRNHFNTLWPHDHTKYCGIIQEYVDEMEKLASRLLYCILGSLGVTVEDIEWAHKLEKSGSKVGRGAIRLNHYPVCPEPERAMGLAAHTDSTILTILHQSNTGGLQVFREESGWVTVEPAPGVLVVNIGDLFHILSNGKIPSVVHRAKVNHTRSRISIAYLWGVVQLVMCKSHLSLS

SEQ ID NO: 1008 - protein, 240 aa, Ricinus communis
  misc_feature (1)..(240): Public GI ID no. 255552993
  misc_feature (1)..(240): Bit score of 336.9 for HMM based on sequences of FIGURE 4.
  misc_feature (67)..(163): Pfam Name: 2OG-FeII_Oxy Pfam Description: 2OG-Fe(II) oxygenase superfamily
  misc_feature (1)..(240): Functional Homolog Of SEQ ID NO. 1
MAPQRKIWGGDGIYKRNPIDITEEYQIEMQKLAVRLMWLMLGSLGITSEDVTWAGPEGDFEGASAAALQLNYYPACPDPDKAMGLAAHTDSTLLTILHQNSTSGLQVQKEGTGWVTVPPIPGGLVVHVGDLLHILSNGLYPSVIHRAVVNRTKHRLSVAYLYGPPSSIQISPLSKLVGPSQPPLYKAVTFFEYLGTKAKHFNEALSRVRVCAPLSGSLLDVNEHSNNNNNSNNNNRVKVG

SEQ ID NO: 1009 - protein, 440 aa, Cyphostemma cf. serpens 11447
  misc_feature (1)..(440): Public GI ID no. 119713908
  misc_feature (1)..(440): Bit score of 701.2 for HMM based on sequences of FIGURE 3.
  misc_feature (114)..(440): Pfam Name: GRAS Pfam Description: GRAS family transcription factor
  misc_feature (34)..(98): Pfam Name: DELLA Pfam Description: Transcriptional regulator DELLA protein N terminal
  misc_feature (1)..(440): Functional Homolog Of SEQ ID NO. 188
MLSEFNPPPHHFLPSLDFPQPKEEEQPPSSSLFDSSPPAMDAGLDAIPGKALYSHIEPSPPTAPLYQRDSKRLKPTINSTSNSVSSAIGGWGLPPSESARPVVLVDSQETGIRLVHTLMACAEAVQQENMKLAEALVKQIGFLAVSQAGAMRKVATYFAEGLARRIYRLYPDKPLDTSFSDILQMHFYETCPYLKFAHFTANQAILEAFEGKKRVHVIDFSMKQGMQWPALMQALALRPEGAPSFRLTGIGPPSTDNTDHLHEVGWKLAQLAETIHVEFEYRGFVANSLADLDASMLELREAESVAVNSVFELHGLLARPGGIERVLSAVKDMKPEIVTIVEQEANHNGPVFLDRFTESLHYYSTLFDSLEGCGASPVNSQDKLMSEVYLGQQICNVVACEGPERLERHETLAQWRARLGSAGFDPVNLGSNAFKQASML

SEQ ID NO: 1010 - protein, 581 aa, Zea mays subsp. mays
  misc_feature (1)..(581): Public GI ID no. 15866400
  misc_feature (1)..(581): Bit score of 1054.8 for HMM based on sequences of FIGURE 3.
  misc_feature (243)..(581): Pfam Name: GRAS Pfam Description: GRAS family transcription factor
  misc_feature (38)..(114): Pfam Name: DELLA Pfam Description: Transcriptional regulator DELLA protein N terminal
  misc_feature (1)..(581): Functional Homolog Of SEQ ID NO. 188
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRTVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 1011 - protein, 518 aa, Madia sativa
  misc_feature (1)..(518): Public GI ID no. 20257442
  misc_feature (1)..(518): Bit score of 753.2 for HMM based on sequences of FIGURE 3.
  misc_feature (169)..(518): Pfam Name: GRAS Pfam Description: GRAS family transcription factor
  misc_feature (2)..(68): Pfam Name: DELLA Pfam Description: Transcriptional regulator DELLA protein N terminal
  misc_feature (1)..(518): Functional Homolog Of SEQ ID NO. 188
MDELLEVLGYKVKSTDMADVAQKLEQLEMVMGEDGVLQLSDTVHYNPSDLSGWVQSMLLVLNEDNNNTLDDDVSDHILLPGNSSTTMIDFSSSRTETVNRKHGSKMLEDDPYDLRAIAGGAIYRPESEGIGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNALETSCNENLQMHFYETCPYLKFAHFTANQAILEAFAGATRVHVIDFSLNQGMQWPALMQALALRSGGPPAFRLTGIGPPQPDNSDALQQVGWKLAQLADTIGVEFEFRGFVANSIADIDANMLDIRASETEVVAVNSVFEVHRLLARPGSVEKVLSSITGMKPKIVTLVEQESNHNGAVFMERFNEALHYYSTMFDSLESSALTLPNSQDDLVMSEVYLGRQICNVVACEGTDRVERHETLTQWRVRMNSAGFEPVHLGSNAFKQASMLLALFSGGDGYRVEENDGCLM

SEQ ID NO: 1012 - protein, 617 aa, Eragrostis tef
  misc_feature (1)..(617): Public GI ID no. 380504012
  misc_feature (1)..(617): Bit score of 1157.1 for HMM based on sequences of FIGURE 3.
  misc_feature (236)..(613): Pfam Name: GRAS Pfam Description: GRAS family transcription factor
  misc_feature (38)..(110): Pfam Name: DELLA Pfam Description: Transcriptional regulator DELLA protein N terminal
  misc_feature (1)..(617): Functional Homolog Of SEQ ID NO. 188
MKREYQDASGSAAGGSDLGSSKDKMMVAPAGEQDEEVDELLAALGYKVRSSDMADVAQKLEQLEMAMGMGGVPAADDGFVSHLAADTVHYNPSDLSSWVESMLSELNAPPPPLPPAPAPPAPQLVSTSSTVTGGGSGAGYFDPPPAVDSSSSTYALKPIPSPVAAPADPSADSAREPKRMRTGGGSTSSSSSSSSSMGGGGARSAVVEAAPPASAAANAPAVPVVVVDTQEAGIRLVHALLACAEAVQQENFSAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEENDEEPEVIAVNSVFEMHRLLAQPGALEKVLGTVRAVRPKIVTVVEQEANHNSGSFLDRFTQSLHYYSTMFDSLEGGGSGQSDASPGAAAGTDQVMSEVYLGRQICNVVACEGAERTERHETLVQWRNRLGRAGFEPVHLGSNAYKQASTLLALFAGGDGYRVEEKDGCLTLGWHTRPLIATSAWRLAAA

SEQ ID NO: 1013 - protein, 618 aa, Eragrostis tef
  misc_feature (1)..(618): Public GI ID no. 380503998
  misc_feature (1)..(618): Bit score of 1156.7 for HMM based on sequences of FIGURE 3.
  misc_feature (236)..(614): Pfam Name: GRAS Pfam Description: GRAS family transcription factor
  misc_feature (38)..(110): Pfam Name: DELLA Pfam Description: Transcriptional regulator DELLA protein N terminal
  misc_feature (1)..(618): Functional Homolog Of SEQ ID NO. 188
MNREYQDGGGSSAGGSDLGSSKDKMMVAPAGEQDEEVDELLAALGYKVRSSDMADVAQKLEQLEMAMGMGGVPAADDGFVSHLATDTVHYNPSDLSSWVESMLSELNAPPPPLPPAPAPPAPQLVSTSSTVTGGGSGAGYFDPPPAVDSSSSTYALKPIPSPVAAPADPSADSAREPKRMRTGGGSTSSSSSSSSSMGGGGARSSVVEAAPPASAAANAPAVPVVVVDTQEAGIRLVHALLACAEAVQQENFSAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEENDEEPEVIAVNSVFEMHRLLAQPGALEKVLGTVRAVRPKIVTVVEQEANHNSGSFLDRFTQSLHYYSTMFDSLEGGGSGQSDAASPGAAAGTDQVMSEVYLGRQICNVVACEGAERTERHETLVQWRNRLGRAGFEPVHLGSNAYKQASTLLALFAGGDGYRVEEKDGCLTLGWHTRPLIATSAWRLAAA

SEQ ID NO: 1014 - protein, 617 aa, Eragrostis tef
  misc_feature (1)..(617): Public GI ID no. 380504056
  misc_feature (1)..(617): Bit score of 1153.3 for HMM based on sequences of FIGURE 3.
  misc_feature (236)..(613): Pfam Name: GRAS Pfam Description: GRAS family transcription factor
  misc_feature (38)..(110): Pfam Name: DELLA Pfam Description: Transcriptional regulator DELLA protein N terminal
  misc_feature (1)..(617): Functional Homolog Of SEQ ID NO. 188
MKREYQDASGSAAGGSDLGSSKDKMMVAPAGEQDEDVDELLAALGYKVRSSDMADVAQKLEQLEMAMGMGGVPAADDGFVSHLAADTVHYNPSDLSSWVESMLSELNAPPPPLPPAPAPPAPQLVSTSSTVTGGGSGAGYFDPPPAVDSSSSTYALKPIPSPVAAPADPSADSAREPKRMRTGGGSTSSSSSSSSSMGGGGARSAVVEAAPPASAAANAPAVPVVVVDTQEAGIRLVHALLACAEAVQQENFSAAEALVKQIPMLASSQGRAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEENDEEPEVIAVNSVFEMHRLLAQPGALEKVLGTVRAVRPKIVTVVEQEANHNSGSFLDRFTQSLHYYSTMFDSLEGGASGQSDASPGAAAGTDQVMSEVYLGRQICNVVACEGAERTERHETLVQWRNRLGRAGFEPVHLGSNAYKQASTLLALFAGGDGYRVEEKDGCLTLGWHTRPLIATSAWRLAAA

SEQ ID NO: 1015 - protein, 581 aa, Zea mays subsp. mays
  misc_feature (1)..(581): Public GI ID no. 15866316
  misc_feature (1)..(581): Bit score of 1058.1 for HMM based on sequences of FIGURE 3.
  misc_feature (243)..(581): Pfam Name: GRAS Pfam Description: GRAS family transcription factor
  misc_feature (38)..(114): Pfam Name: DELLA Pfam Description: Transcriptional regulator DELLA protein N terminal
  misc_feature (1)..(581): Functional Homolog Of SEQ ID NO. 188
MKREYQDAGGSGGDMGSSKDKMMAAAAVAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 1016 - protein, 537 aa, Argyroxiphium sandwicense subsp. macrocephalum
  misc_feature (1)..(537): Public GI ID no. 20257440
  misc_feature (1)..(537): Bit score of 764.2 for HMM based on sequences of FIGURE 3.
  misc_feature (188)..(537): Pfam Name: GRAS Pfam Description: GRAS family transcription factor
  misc_feature (24)..(89): Pfam Name: DELLA Pfam Description: Transcriptional regulator DELLA protein N terminal
  misc_feature (1)..(537): Functional Homolog Of SEQ ID NO. 188
MKRSRERKKEAKTTSSVPDSGGMDELLEVLGYKVKSTDMADVAQKLEQLEMVMGEDGVLQLSDTVHYNPSDLSGWVQSMLSVLNDNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRPSETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 1017 - protein, 544 aa, Argyroxiphium kauense
  misc_feature (1)..(544): Public GI ID no. 20257463
  misc_feature (1)..(544): Bit score of 859.5 for HMM based on sequences of FIGURE 3.
  misc_feature (195)..(544): Pfam Name: GRAS Pfam Description: GRAS family transcription factor
  misc_feature (24)..(91): Pfam Name: DELLA Pfam Description: Transcriptional regulator DELLA protein N terminal
  misc_feature (1)..(544): Functional Homolog Of SEQ ID NO. 188
MKRSRERKKEAKTTSSVPDSGGMDELLEVLGYKVKSTDMADVAQKLEQLEMVMGEDGILQLSDTVHYNPSDLSGWVQSMLLVLNDNNNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHNDLKLADALVKHVGILVALQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLEGSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 1018 - protein, 525 aa, Calycadenia multiglandulosa
  misc_feature (1)..(525): Public GI ID no. 20257451
  misc_feature (1)..(525): Bit score of 869.6 for HMM based on sequences of FIGURE 3.
  misc_feature (177)..(525): Pfam Name: GRAS Pfam Description: GRAS family transcription factor
  misc_feature (20)..(81): Pfam Name: DELLA Pfam Description: Transcriptional regulator DELLA protein N terminal
  misc_feature (1)..(525): Functional Homolog Of SEQ ID NO. 188
MAPAAKAKDLQNPPDSGGMDELLEVLGYKVKSTDMDDVAQKLEQLEMVMGEDGILQLSDTVHYNPSDLSGWVQSMLSELNNSGGDSDIGIGIPAGGESSTTMIDFSNNKEKQPEDPYDLRAIAGGAIYGEGSESSGNGIKRMKMKSTAEGSGAVDVPPESPPRPVVLVDSQEAGIRLVHTLMACAEAVQNNDMKLAEALVKHVGILVASQAGAMAKVATYFAGALAQRIYKIYPQDGGLETSCWEILQMHFYESCPYLKFAHFTANQAILEAFAGAARVHVIDFSLNQGMQWPALMQALALRPGGPPAFRLTGIGPPQPDNTDALQQVGWKLAQLADTIGVEFEFRGFVAASIADIDAAMLDIRLDEVVAVNSVFELHRLLARPGAVEKVLSSITSMKPKIVTLVEQESNHNGVVFMDRFNEALHYYSTMFDSLESSALTQPNSQQDLVMSEVYLGRQICNVVACEGPDRVERHETLTQWRTRMISAGFEPVHLGSNAFKQASMLLALFAGGDGYRVEENDGCLM

SEQ ID NO: 1019 - protein, 618 aa, Eragrostis tef
  misc_feature (1)..(618): Public GI ID no. 380503968
  misc_feature (1)..(618): Bit score of 1155.6 for HMM based on sequences of FIGURE 3.
  misc_feature (236)..(614): Pfam Name: GRAS Pfam Description: GRAS family transcription factor
  misc_feature (38)..(110): Pfam Name: DELLA Pfam Description: Transcriptional regulator DELLA protein N terminal
  misc_feature (1)..(618): Functional Homolog Of SEQ ID NO. 188
MKREYQDGGGSSAGGSDLGSSKDKMMVAPAGEQDEEVDELLAALGYKVRSSDMADVAQKLEQLEMAMGMGGVPAADDGFVSHLATDTVHYNPSDLSSWVESMLSELNAPPPPLPPAPAPPAPQLVSTSSTVTGGGSGAGYFDPPPAVDSSSSTYALKPIPSPVAAPAEPSADSAREPKRMRTGGGSTSSSSSSSSSMGGGGARSSVVEAAPPASAAANAPAVPVVVVDTQEAGIRLVHALLACAEAVQQENFSAAEALVKQIPMLASSQGGAMRKVAAYFGEALARRVYRFRPAPDSSLLDAAFADLLHAHFYESCPYLKFAHFTANQAILEAFAGCRRVHVVDFGIKQGMQWPALLQALALRPGGPPSFRLTGVGPPQPDETDGLQQVGWKLAQFAHTIRVDFQYRGLVAATLADLEPFMLQPEGEENDEEPEVIAVNSVFEMHRLLAQPGALEKVLGTVRAVRPKIVTVVEQEANHNSGSFLDRFTQSLHYYSTMFDSLEGGGSGQSDAASPGAAAGTDQVMSEVYLGRQICNVVACEGAERTERHETLVQWRNRLGRAGFEPVHLGSNAYKQASTLLALFAGGDGYRVEEKDGCLTLGWHTRPLIATSAWRLAAA

SEQ ID NO: 1020 - protein, 581 aa, Zea mays subsp. mays
  misc_feature (1)..(581): Public GI ID no. 15866328
  misc_feature (1)..(581): Bit score of 1055.6 for HMM based on sequences of FIGURE 3.
  misc_feature (243)..(581): Pfam Name: GRAS Pfam Description: GRAS family transcription factor
  misc_feature (38)..(114): Pfam Name: DELLA Pfam Description: Transcriptional regulator DELLA protein N terminal
  misc_feature (1)..(581): Functional Homolog Of SEQ ID NO. 188
MKREYQDAGGSGGDMGSSKDKMMAAAAVAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVKQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 1021 - protein, 582 aa, Zea mays subsp. mays
  misc_feature (1)..(582): Public GI ID no. 15866334
  misc_feature (1)..(582): Bit score of 1059.9 for HMM based on sequences of FIGURE 3.
  misc_feature (244)..(582): Pfam Name: GRAS Pfam Description: GRAS family transcription factor
  misc_feature (39)..(115): Pfam Name: DELLA Pfam Description: Transcriptional regulator DELLA protein N terminal
  misc_feature (1)..(582): Functional Homolog Of SEQ ID NO. 188
MKREYQDAGGSGGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 1022 - protein, 581 aa, Zea mays subsp. mays
  misc_feature (1)..(581): Public GI ID no. 15866348
  misc_feature (1)..(581): Bit score of 1053.6 for HMM based on sequences of FIGURE 3.
  misc_feature (243)..(581): Pfam Name: GRAS Pfam Description: GRAS family transcription factor
  misc_feature (38)..(114): Pfam Name: DELLA Pfam Description: Transcriptional regulator DELLA protein N terminal
  misc_feature (1)..(581): Functional Homolog Of SEQ ID NO. 188
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVKSEVYLGRQICNVVACEGAERTERHETLGQWRSRLGGSGFAPVHLGSNA

SEQ ID NO: 1023 - protein, 255 aa, Rosa gallica
  misc_feature (1)..(255): Public GI ID no. 157154012
  misc_feature (1)..(255): Bit score of 213.0 for HMM based on sequences of FIGURE 3.
  misc_feature (148)..(255): Pfam Name: GRAS Pfam Description: GRAS family transcription factor
  misc_feature (1)..(41): Pfam Name: DELLA Pfam Description: Transcriptional regulator DELLA protein N terminal
  misc_feature (1)..(255): Functional Homolog Of SEQ ID NO. 188
MGTVQEDGLSQLASDTVHYNPSDLSTWLESMISEITPPPNFDPVMAATPPLNHLAGSSFLAPAESSTITSIDFGDHTNTNSKSLSPRTQFEDCSSSNYELKAIPGKAIFSQTQFDASPREPKRLKPTNSSLQTRPVVVVDSQENGVRLVHGLMACAEAVQRKNFDLAKALVTQISYLAISQAGAMRKVATFFAEALAQRIWGVYPQPPIDHTYSEMLQMHFYETCPYLKFAHFTANQAILEGFQDKKRVHVIDFS

SEQ ID NO: 1024 - protein, 343 aa, Glycine max
  misc_feature (1)..(343): Public GI ID no. 356535621
  misc_feature (1)..(343): Bit score of 643.2 for HMM based on sequences of FIGURE 2.
  misc_feature (107)..(320): Pfam Name: Abhydrolase_3 Pfam Description: alpha/beta hydrolase fold
  misc_feature (103)..(146): Pfam Name: COesterase Pfam Description: Carboxylesterase
  misc_feature (1)..(343): Functional Homolog Of SEQ ID NO. 99
MTESNNEVNLSESKSVVPLNTWVLISNFKLAYNLLRRADGTFNRELAEFLDRKVPANTIPVDGVFSFDHVERSTGLFNRVYQVAPENMGRFIELEKPLSTTKIVPVIIFFHGGSFSHSSANSAIYDIFCRRLVSNCKAVVVSVNYRRSPEYRYPCAYDDGWSALNWVKSRTWLQSGKDSKVHVYLAGDSSGGNIAHHVAVRAAEEDIEVLGNILLHPLFGGEKRTESEMKLDGKYFVRLQDRDWYWRAFLPEGADRDHPACNPFGPKGKNLQGLKLPKSLVCVAGLDLLQDWQLEYVEGLKNCGQDVKLLYLKEATIGFYFLPNNDHFYTLMEEIKNFVNPNC

SEQ ID NO: 1025 - protein, 361 aa, Fragaria W ananassa
  misc_feature (1)..(361): Bit score of 628.9 for HMM based on sequences of FIGURE 2.
  misc_feature (124)..(337): Pfam Name: Abhydrolase_3 Pfam Description: alpha/beta hydrolase fold
  misc_feature (120)..(216): Pfam Name: COesterase Pfam Description: Carboxylesterase
  misc_feature (1)..(361): Functional Homolog Of SEQ ID NO. 99
MRILYNQSKEVPLSKVVPSNPSNLFSFLQRVVPLNTWVLISNFKLSYNLLRRSDGTFNRELAEFLDRKVPANTIPVDGVFSFDHVDRSTGLLNRVYQMAPANYAQWDIANLEKPLSTTEIVPVIIFFHGGSFTHSSANSAIYDTFCRRLVKTCKAAAVSVDYRRSPEHRYPCAYEDGCAALKWVKSRTWLQSGKDSKVYVYLAGDSSGGNIVHHVAVRAAEAEVEVLGNILVHPMFGGQMRTESEVKLDGKYFVTVQDRDWYWRAFLPEGEDRDHPACNTFGPRDKGIQGLKFPKSLVVVAGLDLMQDWQLAYVEGLRISGQEVKLVFLKEATIGFYFLPNNKHFCRLMEEISNFVKPDCC

SEQ ID NO: 1026 - protein, 344 aa, Gossypium hirsutum
  misc_feature (1)..(344): Public GI ID no. 225346669
  misc_feature (1)..(344): Bit score of 687.1 for HMM based on sequences of FIGURE 2.
  misc_feature (108)..(321): Pfam Name: Abhydrolase_3 Pfam Description: alpha/beta hydrolase fold
  misc_feature (99)..(199): Pfam Name: COesterase Pfam Description: Carboxylesterase
  misc_feature (1)..(344): Functional Homolog Of SEQ ID NO. 99
MAGSNEVNLNESKRVVPLNTWVLISNFKLAYNLQRRPDGTFNRDLSEFLDRRVPANINPVDGVFSFDHVDGATGLLNRVYQPSSLNEAQWGMVDLEKPLSTTEIVPVIVFFHGGSFTHSSANSAIYDTFCRRLVSLCKAVVVSVNYRRSPEHRYPCAYDDGWAALKWVKSRTWLQSGKDSNVHVYLAGDSSGGNIAHHVAVRAAEADVEVLGDTLLHPMFGGQKRTESEKRLDGKYFVTLHDRDWYWRAYLPEGEDRDHPACNPFGPRGRSLEGLKFPKSLVVVAGLDLIQDWQLAYVEGLKKSGQEVNLLFLEKATIGFYFLPNNNHFYCLMEEIKNFVNPNC

SEQ ID NO: 1027 - protein, 366 aa, Hordeum vulgare subsp. vulgare
  misc_feature (1)..(366): Public GI ID no. 326517960
  misc_feature (1)..(366): Bit score of 240.7 for HMM based on sequences of FIGURE 2.
  misc_feature (114)..(338): Pfam Name: Abhydrolase_3 Pfam Description: alpha/beta hydrolase fold
  misc_feature (108)..(156): Pfam Name: COesterase Pfam Description: Carboxylesterase
  misc_feature (1)..(366): Functional Homolog Of SEQ ID NO. 99
MAITLHRAQQRKMSGDVARKELRARVGAMPWAVRLQLRALEAAVDATQRRDGTVNRFLFSLLVDRQAPANPARADAGGVRSVDFTVDASTGVPARVYFAAAAGAEAEASPHPVIVYFHGGGFTVFSAATRPYDVLCRTICRETGAVVVSVTYRLAPEHRYPAAYDDGEAALRYLATTGLPAEVPVRVDLSRCFLAGDSAGANIAHHVAQRWTAAPAATTPPAIHLVGLLLLSAYFGGEDRTESEKALEGVAPIVNLRRSDFWWKAFLPEGADRNHPAAHVTGEAGPEPELPDAFPPAMVVVGGLDPLQEWGRLYAAMLRRKGKEVRVVEFTEAVHAFYFFPALPDTGKLVGEIRAFVESIAPRSTA

SEQ ID NO: 1028 - protein, 344 aa, Carica papaya
  misc_feature (1)..(344): Bit score of 667.3 for HMM based on sequences of FIGURE 2.
  misc_feature (108)..(321): Pfam Name: Abhydrolase_3 Pfam Description: alpha/beta hydrolase fold
  misc_feature (81)..(149): Pfam Name: COesterase Pfam Description: Carboxylesterase
  misc_feature (1)..(344): Functional Homolog Of SEQ ID NO. 99
MAGGNEVNLNESKRVVPLNTWVLISNFKLAYNILRRSDGSFNRELAEFLDRKLPANTIPVDGVFSFDHVDRATGLLNRVYQPAPSNPTQWGTVDLENSLSTTEIVPVIVFFHGGSFTHSSANSAIYDTFCRRLVSVCKAVVVSVNYRRSPEYRYPSAYDDGWAALKWVKSRTWLQSGKDSKVYVYLAGDSSGGNIAHNVAVRAAESDIEVFGNILLHPMFGGQERTESEKRLDGKYFVTIQDRDWYWRAFLPEGEDRDHPASNPFGPRGKNIEELKFPKSLVVVAGFDLIQDWQLNYVEGLRKAGQAVKLLFLEQATIGFYFLPNNSHFYCLMEEIKDFIHPNC

SEQ ID NO: 1029 - protein, 273 aa, Physcomitrella patens subsp. patens
  misc_feature (1)..(273): Public GI ID no. 168011953
  misc_feature (1)..(273): Bit score of 221.4 for HMM based on sequences of FIGURE 2.
  misc_feature (62)..(264): Pfam Name: Abhydrolase_3 Pfam Description: alpha/beta hydrolase fold
  misc_feature (55)..(173): Pfam Name: COesterase Pfam Description: Carboxylesterase
  misc_feature (1)..(273): Functional Homolog Of SEQ ID NO. 99
MVGTIPRRKDGTVHRKLADLFEWVISANPQRADGVVAFDVVVDAETGIWVRVFVPAQMMPVIVYYHGGGFVFMKPNVTLYDQFCRRLAGKCSAVVVSVHYRQAIGSVLRILSTAPEHKCPTAYNDCYAVLEWLNSEKAEAILPANVDLSRVYLAGDSAGGNIAHHVAILAAGKDLSPLTLRGLVLIQPFFGGEERTAAELQMKDPLIVSLELLDWYWKAYLPPDSNRDHPASNVFGPYSRDISNVAIPPVLVIVGGLDPLQEWQASSFITWVS

SEQ ID NO: 1030 - DNA, 1191 bp, Arabidopsis thaliana
  misc_feature (1)..(1191): Ceres Clone ID no. 42187
  misc_feature (1)..(1191): Encodes the peptide sequence at SEQ ID NO. 1031
aattaatcatcatcttttcttcacagagaggaaaaaaaaaaaatggcgacagattctcaaccaaaccaaaagctaacgcttccgttaaaaacaagaatcgctctcaccgttatctccaccatgaccgataacgctcaacgtcctgacggaactatcaaccgccgtttcctccgcctcttcgatttccgtgctcctcccaatcctaaacccgtcaacatcgtctccacctccgatttcgtcgtggatcaatcccgtgatctctggttccgattgtacactccacatgtctccggcgataaaatccccgtcgttgttttcttccacggcggtggtttcgctttccttagtcctaatgcgtatccttacgataatgtatgccggagattcgctaggaaattacctgcttatgtcatctccgttaactaccgtctcgctccggagcatcgttatcctgctcaatacgacgacggtttcgatgctttgaagtacatcgaggagaatcacggttcgattcttccggcgaacgctgatctctcgagatgcttcttcgccggagacagtgcaggtggaaacatcgcgcacaacgtcgcgattcgaatttgtcgcgagccgcggtcatctttcaccgccgtgaaactcatcggacttatctcgattcaacctttcttcggcggagaagagagaacggaagcggagaaacaactcgtcggagctcctttggtttcaccggaccgaacagattggtgctggaaagcgatgggattaaaccgggatcatgaagcggttaacgtaggcggaccaaacgcggttgatatatcgggtctggattatccggagacgatggtggtagtagctgggtttgatccgttaaaagattggcagagaagttactacgagtggttaaagttatgcggtaaaaaagcaacgttaatcgaatattcaaacatgtttcatgcgttttacattttccctgaattgcctgaggcgggtcagttaattatgcggattaaggattttgttgatgagcgcgtggcttcactctccgcttaatcaccttcgctaatgatggatttttaaattagctcaatgaataataatgtattaagctctatgcttgtgtcttgtttagtgttttaaaaatggtgtaggtcgatctattttcattattaatcaagtgttcaactttaagtg

SEQ ID NO: 1031 - protein, 335 aa, Arabidopsis thaliana
  misc_feature (1)..(335): Ceres Clone ID no. 42187
  misc_feature (1)..(335): Bit score of 236.2 for HMM based on sequences of FIGURE 2.
  misc_feature (90)..(307): Pfam Name: Abhydrolase_3 Pfam Description: alpha/beta hydrolase fold
  misc_feature (78)..(132): Pfam Name: COesterase Pfam Description: Carboxylesterase
  misc_feature (1)..(335): Functional Homolog Of SEQ ID NO. 99
MATDSQPNQKLTLPLKTRIALTVISTMTDNAQRPDGTINRRFLRLFDFRAPPNPKPVNIVSTSDFVVDQSRDLWFRLYTPHVSGDKIPVVVFFHGGGFAFLSPNAYPYDNVCRRFARKLPAYVISVNYRLAPEHRYPAQYDDGFDALKYIEENHGSILPANADLSRCFFAGDSAGGNIAHNVAIRICREPRSSFTAVKLIGLISIQPFFGGEERTEAEKQLVGAPLVSPDRTDWCWKAMGLNRDHEAVNVGGPNAVDISGLDYPETMVVVAGFDPLKDWQRSYYEWLKLCGKKATLIEYSNMFHAFYIFPELPEAGQLIMRIKDFVDERVASLSA

SEQ ID NO: 1032 - protein, 351 aa, Zea mays
  misc_feature (1)..(351): Bit score of 682.9 for HMM based on sequences of FIGURE 2.
  misc_feature (115)..(328): Pfam Name: Abhydrolase_3 Pfam Description: alpha/beta hydrolase fold
  misc_feature (110)..(154): Pfam Name: COesterase Pfam Description: Carboxylesterase
  misc_feature (1)..(351): Functional Homolog Of SEQ ID NO. 99
MAGSDEVNRNECKGAVPIHTWVLISNFKLAYNMLRRADGTFDRDLAEFLDRRVPPDARAQEGVSSSDHVIDTSTGLEVRIYRAATNNGGAGAAAVTLPILDFLGGGPSPDPFPVILFFHGGSFAHSSSGTAIYDNLCRRFVKLSKGVVVSVNYRRAPEHRYPCAYDDGWAALKWATSQPFLRSGGDGRPRVFLSGDSSGGNIAHHVAVRAADAGINICGNILLNAMFGGTERTESERRLDGKYFVTLQDRDWYWKAYLPEDADRDHPACNPFGPNGRRLRGLPFTKSLIIVSGLDLTCDRQLAYAEGLQQDGHHVKVVYREKATVGFYLLSNTDHYHEVMEEIGDFLAANL

SEQ ID NO: 1033 - protein, 344 aa, Arabidopsis lyrata subsp. lyrata
  misc_feature (1)..(344): Public GI ID no. 297829024
  misc_feature (1)..(344): Bit score of 639.3 for HMM based on sequences of FIGURE 2.
  misc_feature (109)..(322): Pfam Name: Abhydrolase_3 Pfam Description: alpha/beta hydrolase fold
  misc_feature (80)..(148): Pfam Name: COesterase Pfam Description: Carboxylesterase
  misc_feature (1)..(344): Functional Homolog Of SEQ ID NO. 99
MAASDEVNLIESRTVVPLNTWVLISNFKVAYNILRRPDGTFNRHLAEYLDRKVTANANPVDGVFSFDVLIDRRINLLSRVYRPAYADQEQPPSVLDLEKPVDGDIVPVILFFHGGSFAHSSANSAIYDTLCRRLVGLCKCVVVSVNYRRAPENPYPCAYDDGWIALNWVNSRAWLKSKKDSKVHIFLAGDSSGGNIAHNVALKAGESGINVLGNILLNPMFGGNERTESEKSLDGKYFVTVRDRDWYWKAFLPEGEDREHPACNPFSPRARSLEGLSFPKSLVVVAGLDLIRDWQLAYAEGLKKAGQEVKLMHLEKATVGFYLLPNNNHFHNVMDEISAFVNER

SEQ ID NO: 1034 - protein, 344 aa, Glycine max
  misc_feature (1)..(344): Public GI ID no. 356576751
  misc_feature (1)..(344): Bit score of 650.3 for HMM based on sequences of FIGURE 2.
  misc_feature (108)..(321): Pfam Name: Abhydrolase_3 Pfam Description: alpha/beta hydrolase fold
  misc_feature (91)..(147): Pfam Name: COesterase Pfam Description: Carboxylesterase
  misc_feature (1)..(344): Functional Homolog Of SEQ ID NO. 99
MAGSNELNPNDSKMVVPLNMWVLISNFKLAYNLLRRPDGTFNRDLAEFLDRKVPANANPVDGVFSFDVIVDRETNLLTRIYRLAEGEERSVNILDLEKPVNSEVVPVIIFFHGGSFAHSSANSAIYDTLCRRLVGICKAVVVSVNYRRAPENRYPCAYDDGWTALKWVSSASWLQSRKDKKVHIYMAGDSSGGNIVHHVALKAMESGIEVFGNILLNPLFGGQERTESEKRLDGRYFVGVKDRDWYWRAFLPEGEDRDHHACNPFGPKGKSLEGITFPKSLVVVAGLDLVQDWQLGYAKGLEKAGQEVKLLFLEQATVGFYLLPNNEHFSPVMDEIKYFVGSDC

SEQ ID NO: 1035 - protein, 344 aa, Cajanus cajan
  misc_feature (1)..(344): Bit score of 672.2 for HMM based on sequences of FIGURE 2.
  misc_feature (108)..(321): Pfam Name: Abhydrolase_3 Pfam Description: alpha/beta hydrolase fold
  misc_feature (104)..(150): Pfam Name: COesterase Pfam Description: Carboxylesterase
  misc_feature (1)..(344): Functional Homolog Of SEQ ID NO. 99
MTGSNELNLNESKSVVPLNTWVLISNFKLAYNLLRRADGTFNRELAEFLDRKVPANTIPVDGVFSFDHVDRNTGLFNRVYQLAPQNESRCSIIELEKPLSTTEIVPVIIFFHGGSFSHSSANSAIYDTFCRRLVSICKAVVVSVNYRRSPEYRYPCAYDDGWAALKWVKSRTWLQSGKDSKVHVYLAGDSSGGNIAHHVAVRAAEEDIEVLGNILLHPLFGGEKRTESEKKLDGKYFVRLQDRDWYWRAFLPEGADRDHPACNPFGPKGKSLAGLKFPKSLVCVAGLDLLQDWQLEYVEGLKNSGQDAKLLYLKEATIGFYFLPNNDHFYTLMEEIENFVNSNC

SEQ ID NO: 1036 - protein, 354 aa, Oryza sativa Indica Group
  misc_feature (1)..(354): Public GI ID no. 125559352
  misc_feature (1)..(354): Bit score of 250.3 for HMM based on sequences of FIGURE 2.
  misc_feature (104)..(326): Pfam Name: Abhydrolase_3 Pfam Description: alpha/beta hydrolase fold
  misc_feature (95)..(146): Pfam Name: COesterase Pfam Description: Carboxylesterase
  misc_feature (1)..(354): Functional Homolog Of SEQ ID NO. 99
MGHEKEQETAGDELRRPEPPALPWTVRLQLFALVTAVDLVQRGDGTVNRFLFSLADRQSAAAARPDANGVRSGDVTVDAARGLWARVFSPASSGAVESPPLPVVVYFHGGGFALLTAASSQYDALCRRLCRELRAVVVSVNYRLAPEHRYPAAYDDGMDVLRHLGTVGLPAEVAAAVPVDLTRCFLVGDSAGGNIAHHVAHRWAAATTSSSRRVRLAGVVLLQPFFGGEERTEAELRLDGVGPVVSMARADWCWRAFLPEGTDRDHPAAHVTGESAELAEAFPPAMVVVGGYDTLQDWQRRYAGMLRRKGKAVQVVEYPAAIHSFYVFPELADSGELIKEMKAFMERNKPPKYC

SEQ ID NO: 1037 - protein, 361 aa, Brachypodium distachyon
  misc_feature (1)..(361): Public GI ID no. 357116238
  misc_feature (1)..(361): Bit score of 233.7 for HMM based on sequences of FIGURE 2.
  misc_feature (108)..(331): Pfam Name: Abhydrolase_3 Pfam Description: alpha/beta hydrolase fold
  misc_feature (102)..(150): Pfam Name: COesterase Pfam Description: Carboxylesterase
  misc_feature (1)..(361): Functional Homolog Of SEQ ID NO. 99
MTGFVQQAAKEGTMAREELRARVRAALPWTVRLQLRALEAAVDATQRRRDGTVNRFLFNLLADRRVAPTTTSGSVRSLDVTVDASTGVTARVFFNSGAPTAPSPRPVVVYFHGGGFTVFSAATGPYDSLCRSICLGSGAVVVSLSYRLAPEHRFPAAYDDGAAALRFLTTSSAASQIPVPIDLSRCFLAGDSAGANIAHHVAHRFTSSSSSPPPNIQIAGIILLSAYFGGQERTESELALEGVAPIVNLRRSDFWWKAFLPAGADRNHPAAHVTGEAGPEPELGEAFPPALVVVGGLDPLQDWGRRYAAMLRRMGKSVKVVEFPEAVHAFYFFPALPESARLVEEIKAFVQQDAEPNSNSS

SEQ ID NO: 1038 - protein, 357 aa, Hordeum vulgare subsp. vulgare
  misc_feature (1)..(357): Public GI ID no. 326513536
  misc_feature (1)..(357): Bit score of 239.0 for HMM based on sequences of FIGURE 2.
  misc_feature (105)..(327): Pfam Name: Abhydrolase_3 Pfam Description: alpha/beta hydrolase fold
  misc_feature (89)..(147): Pfam Name: COesterase Pfam Description: Carboxylesterase
  misc_feature (1)..(357): Functional Homolog Of SEQ ID NO. 99
MEATTKNQETGAGDNSARPAPPALPWSVRLQLFALVTTNDIAQRRDGTVNRFLFSFGDRQSPARPRPDAHGVRSADVTVDASRSLWARVYSPAAAAAGQTPLPVLVYFHGGGFTLLSAASTPIDGMCRRFCRELGAVVVSVNYRLAPEHRYPAAYDDCVDVLRYLGDPGLPADVSVPVDLSRCFLGGDSAGGNIVHHVAQRWTGAPPRNSPVRLAGIILLQPYFGGEERTEAEQRLEGVAPVVNMRRSDWAWRAFLPEGADRNHPAAHVTGEAGPEPELAESFPPAMVAVGGLDPLQDWQRRYGAMLRRKGKAVNVLEFPDAIHAFYCFPELPDSGRLVEEMRAFIGTNAPTHHPDA

SEQ ID NO: 1039 - DNA, 1723 bp, Lycopersicon esculentum
  misc_feature (1)..(1723): Public GI ID no. 225314775
  misc_feature (1)..(1723): Encodes the peptide sequence at SEQ ID NO. 1040
acatccatctctatctctattttaagctgtaaattttactttctttctatatttttttcctcttcatcatcttcttcttcttcttctctatatcctcttttgtcttatttatttttttactctgttcttgtttcagaaactgtcttttcttcttttctgattgaaacccaaaaactaggaatcaataaaatcagtatatgtaaatatacccttttgtctaattaacagtcaaactgtctactcttggtcagttttcagcaaattatgatagataaaaaactcatctttttcaagatttgattttttttggggggtccctttttgttttgcttgaggaatagttatggctgggagtaatgaaattaatgctaatgaatctaagagggtggttccacttaatacatggatccttatatccaatttcaagctttcttacaacatgcttcgtcgtcctgatggcacgtttgatcgtgatttagctgagtttatagaccggaaggtccctacaaactcgattccagttgatggtgtttattcttttgatgtatttgatcgtgtaacgagtcttcttaatcgaatatatcgacctgctcctgaaaatgaggctgattggggtaaaatagagctcgagaaacctctgagcaccacggaaattgttcctgttataatttatttccacggcggaagttttactcattcctcagccaatagtgctatttatgatacattttgtcgccgcctagttaagatttgcaaggctgttgttgtttctgtgaactatagacgatctccagaacatcgatatccttgtgcatacgatgacggatgggctgctctaaaatgggtaaaatcaaggacatggcttcaaagtgggaaggactcgaaagtccacgtctatatggctggcgatagttcaggtggtaatattgctcaccacgttgctgtaagggctgctgaagcaggtgtcgaagtattaggtaatatacatcttcatccaatgtttggtgggcaaaacaggacagaatctgagaagagattagacgggaaatactttgttaccgtacaagacagagattggtactggagggcctatctaccggaaggggaagatagagatcatccggcatgtaacatatttggctcgaggagtagaagcctcaaaggactaaagtttccaaagagtctagtagtggtggctggtttggatcttagtcaggattggcaattggcatatgtcgatggtttgaagaactcggggcatgaggtaaatctcttgtatctaaaacaggcaacaatcggtttctatttcttgccaaacaacgatcattttccttgcctcatggaggagataaccaacttcatccatcctaactgttcatagattaagttaacttcagctatacataacaaaagcttgacatatgtcactcgcgttttattttcttcttcgtttctttctagtcaatagaatgttgttttttagttatatgatagtagaattacttcactcgagcgttcaagccttcaactcatcgtctgcaaggcttgatcttctcgattctaaagcccgatttaacgtgttttcttaggtgaagttagctctctttctgcctgagaattgtgacttgtggaattgtaattttcagaatatgatgttgttgtcaactttgtatgttgtgtttgaggaatatatatatataaagatgtttgttcaaaaaaaaaa

SEQ ID NO: 1040 - protein, 322 aa, Lycopersicon esculentum
  misc_feature (1)..(322): Public GI ID no. 225314775
  misc_feature (1)..(322): Bit score of 609.4 for HMM based on sequences of FIGURE 2.
  misc_feature (85)..(298): Pfam Name: Abhydrolase_3 Pfam Description: alpha/beta hydrolase fold
  misc_feature (66)..(127): Pfam Name: COesterase Pfam Description: Carboxylesterase
  misc_feature (1)..(322): Functional Homolog Of SEQ ID NO. 99
GIVMAGSNEMLRRPDGTFDRDLAEFIDRKVPTNSIPVDGVYSFDVFDRVTSLLNRIYRPAPENEADWGKIELEKPLSTTEIVPVIIYFHGGSFTHSSANSAIYDTFCRRLVKICKAVVVSVNYRRSPEHRYPCAYDDGWAALKWVKSRTWLQSGKDSKVHVYMAGDSSGGNIAHHVAVRAAEAGVEVLGNIHLHPMFGGQNRTESEKRLDGKYFVTVQDRDWYWRAYLPEGEDRDHPACNIFGSRSRSLKGLKFPKSLVVVAGLDLSQDWQLAYVDGLKNSGHEVNLLYLKQATIGFYFLPNNDHFPCLMEEITNFIHPNCS

SEQ ID NO: 1041 - protein, 354 aa, Vitis vinifera
  misc_feature (1)..(354): Public GI ID no. 359493559
  misc_feature (1)..(354): Bit score of 258.8 for HMM based on sequences of FIGURE 2.
  misc_feature (94)..(307): Pfam Name: Abhydrolase_3 Pfam Description: alpha/beta hydrolase fold
  misc_feature (80)..(180): Pfam Name: COesterase Pfam Description: Carboxylesterase
  misc_feature (1)..(354): Functional Homolog Of SEQ ID NO. 99
MSGTAGGKVRKWPDLPWKVRLFVTAFGFLTDASFRRNGKVNRCLINLIDCKVPPSDRPVNGVTTSDTTVDPSRNLWYRYFVPSAAEAGRMLPVVVYFHGGGFVMLSPSSQLFDDLCRLLARELPAVIVSVNYRLAPEHRCPASYEDGVDVLRFIDEKPPANADLTRCFIVGDSAGGNIAHHVTARAGEHNLRNLQIAGVIPIQPYFGGEERTESEIQLEGAPLVSMKRTDWCWKAFLPEGSDRDHPAANVFGPNSSDISGLRFPKSLVFMGGLDPLRDWQKRYCGGLKSNGKEVREADYPNAMHSFYAFPELPESTLFLRELQDFIEKHTPNKNNHTHKTVFTWFGNMPTSTEL

SEQ ID NO: 1042 - protein, 360 aa, Vitis vinifera
  misc_feature (1)..(360): Public GI ID no. 225451094
  misc_feature (1)..(360): Bit score of 669.6 for HMM based on sequences of FIGURE 2.
  misc_feature (108)..(321): Pfam Name: Abhydrolase_3 Pfam Description: alpha/beta hydrolase fold
  misc_feature (104)..(147): Pfam Name: COesterase Pfam Description: Carboxylesterase
  misc_feature (1)..(360): Functional Homolog Of SEQ ID NO. 99
MAGSNEVNLSESKRVVPLNTWILISNFKLAYNLLRRPDGTFNRHLAEFLDRKVPANANPVEGVFSFDVIIDRSTSLLSRIYRPATGEEALPSIMELEKPVTGDIVPVILFFHGGSFAHSSANSAIYDTLCRRLVGICKAVVVSVNYRRAPENPYPCAYDDGWAALKWVNSRPWLKSEEDSKVHIYMVGDSSGGNIVHNVALKAVESGIEVLGNILLNPMFGGQERTESEKRLDGKYFVTIQDRDWYWRAFLPEGEDRDHAACNPFGPNGKSLVGMKFPKSLVVVAGLDLVQDWQLAYVEGLKKAGQEVKHLYLDKATIGFYLLPNNDHFYTVMDEISNFMLKMISLERLAMETNAKIGLF

SEQ ID NO: 1043 - DNA, 1107 bp, Sorghum bicolor
  misc_feature (1)..(1107): Ceres Annot ID no. 8657013
  misc_feature (1)..(1107): Encodes the peptide sequence at SEQ ID NO. 1044
atggcttcagcagctagcgagatggaaggcgaaggcgccggcgccggcaccggcactggggaaggagcgccaatcgcgccgcgcaggccggccctgccgttgaaggtgcggttccagctcatgtgcctcgacgtcgtcggtggcctctcgatgcgtcgcgacggcaccatcaaccgctccctcttcagcctcttcgaccgccgcgcccgcgctagcgcgcgcccggatggcctcggcgtccggtccgccgacgtgcacgtggacgcgtcgcgcggcttgtgggcgcgcgtgttctcgccgtcggaggcggccgggtcaccgctccccgtcgtggtctatttccacggtggcgcattcgcgctgctctccgcggcctcggtcccctacgacgccatgtgccgccggttctgccgcgagctgggcgccgtcgtcgtgtccgtcgactaccgcctcgccccggagcaccgctgccccgccgcgtacgacgacggcgtcgacgtgctccggcacctcgcctccacagggctccccgacggcgtcgccgtgccggtcgacctctcccgctgcttcctcgccggggacagcgccggggccaacatcgctcaccacgtggcgcagcgctggacgacggccggcgtcgcgtcctcctcgtcgtccccgccgcgttcctgccccgtccgcctcgcgggcgtcgtcctggtgcagccgtacctgggcggcgaggagcggacggacgcggaggtcatgctggacgggaaggtgccggtggtcaccgtgcggggctcggactggatgtggcgggcgttcctgccggagggcgccgacaggaaccaccccgccgcgcacgtgaccgacgagaacgccgacctggcggacggctttccgccggcgatggtggtgatcggcggcctcgacccgctgcaggattggcagaggcggtacgccgacgtgctgcggcggaaggggaaggcggtgcgggtggtggagttccaggaggccattcacacgttcttcttcttccccgagctccccgactgcgccaggctcgtggaggcgatgaaggccttcatagatgacagcaacgcatcctccgtctcggctgcttga

SEQ ID NO: 1044 - protein, 368 aa, Sorghum bicolor
  misc_feature (1)..(368): Ceres Annot ID no. 8657013
  misc_feature (1)..(368): Bit score of 228.4 for HMM based on sequences of FIGURE 2.
  misc_feature (111)..(338): Pfam Name: Abhydrolase_3 Pfam Description: alpha/beta hydrolase fold
  misc_feature (97)..(153): Pfam Name: COesterase Pfam Description: Carboxylesterase
  misc_feature (1)..(368): Functional Homolog Of SEQ ID NO. 99
MASAASEMEGEGAGAGTGTGEGAPIAPRRPALPLKVRFQLMCLDVVGGLSMRRDGTINRSLFSLFDRRARASARPDGLGVRSADVHVDASRGLWARVFSPSEAAGSPLPVVVYFHGGAFALLSAASVPYDAMCRRFCRELGAVVVSVDYRLAPEHRCPAAYDDGVDVLRHLASTGLPDGVAVPVDLSRCFLAGDSAGANIAHHVAQRWTTAGVASSSSSPPRSCPVRLAGVVLVQPYLGGEERTDAEVMLDGKVPVVTVRGSDWMWRAFLPEGADRNHPAAHVTDENADLADGFPPAMVVIGGLDPLQDWQRRYADVLRRKGKAVRVVEFQEAIHTFFFFPELPDCARLVEAMKAFIDDSNASSVSAA

SEQ ID NO: 1045 - protein, 361 aa, Fragaria W ananassa
  misc_feature (1)..(361): Bit score of 619.2 for HMM based on sequences of FIGURE 2.
  misc_feature (125)..(338): Pfam Name: Abhydrolase_3 Pfam Description: alpha/beta hydrolase fold
  misc_feature (120)..(164): Pfam Name: COesterase Pfam Description: Carboxylesterase
  misc_feature (1)..(361): Functional Homolog Of SEQ ID NO. 99
MISDMTQKRELPLLHDSGDSESDEEERQEMVVPLNTWVLISNFKLSYTLLRRPDGDFNRHLAEFLDRREPANTIPVEGVFSFDVIIDRETSLLTRVYRPASADAPPNLTIFDLMKPVEDEIVPVIIFFHGGSFAHSSANSAIYDIMCRRLVKTCNAVVVSVNYRRSPEHRYPCAYDDGWTTVKWVNSRSWLRSTKDSKVHIYLAGDSSGGNIVHNVALRAADSEIDVLGNILLNPMFGGQERTATETRLDGKYFVTIQDRDWYWRAFLPEGEDRDHHACNPFGPRGISVKGLKFPRSLVVVAGLDLVQDWQLAYAKGLEDAGQDVKLLYLEQATIGFYLLPNTVHYHTVMNEMSSFVRSDC

SEQ ID NO: 1046 - protein, 344 aa, Vitis vinifera
  misc_feature (1)..(344): Public GI ID no. 381218259
  misc_feature (1)..(344): Bit score of 672.9 for HMM based on sequences of FIGURE 2.
  misc_feature (108)..(321): Pfam Name: Abhydrolase_3 Pfam Description: alpha/beta hydrolase fold
  misc_feature (104)..(147): Pfam Name: COesterase Pfam Description: Carboxylesterase
  misc_feature (1)..(344): Functional Homolog Of SEQ ID NO. 99
MAGSNEVNLSESKRVVPLNTWILISNFKLAYNLLRRPDGTFNRHLAEFLDRKVPANANPVEGVFSFDVIIDRSTSLLSRIYRPATGEEALPSIMELEKPVTGDIVPVILFFHGGSFAHSSANSAIYDTLCRRLVGICKAVVVSVNYRRAPENPYPCAYDDGWAALKWVNSRPWLKSEEDSKVHIYMVGDSSGGNIVHNVALKAVESGIEVLGNILLNPMFGGQERTESEKRLDGKYFVTIQDRDWYWRAFLPEGEDRDHAACNPFGPNGKSLVGMKFPKSLVVVAGLDLVQDWQLAYVEGLKKAGQEVRHLYLDKATIGFYLLPNNDHFYTVMDEISNFVSSNC

SEQ ID NO: 1047 - protein, 345 aa, Medicago truncatula
  misc_feature (1)..(345): Public GI ID no. 357441531
  misc_feature (1)..(345): Bit score of 646.9 for HMM based on sequences of FIGURE 2.
  misc_feature (108)..(321): Pfam Name: Abhydrolase_3 Pfam Description: alpha/beta hydrolase fold
  misc_feature (90)..(147): Pfam Name: COesterase Pfam Description: Carboxylesterase
  misc_feature (1)..(345): Functional Homolog Of SEQ ID NO. 99
MAGSNQLNPNDSKMVVPLNMWVLISNFKLAYNLLRRPDGTFNRDLAEFLDRKVPANANPVDGVFSFDVIVDRETNLLTRIYRPVEGEEQHVNIVDLEKPVTAEVLPVVMFFHGGSFAHSSANSAIYDTLCRRLVGICNAVVVSVNYRRAPENRYPCAYEDGWKAVKWVNSRTWLQSKKDSKVHIYMVGDSSGGNIVHHVALKALDSGIPVLGNILLNPLFGGEERTESEKRLDGRYFVRVKDRDWYWRAFLPEGEDRDHHACNPFGPKGRSLEGVAFPKSLVVVAGLDLVQDWQLGYAKGLEKAGQNVKLLFLEQATVGFYLLPNNEHFSVVMDEIKHFVNSDCS

SEQ ID NO: 1048 - protein, 344 aa, Theobroma cacao
  misc_feature (1)..(344): Bit score of 686.5 for HMM based on sequences of FIGURE 2.
  misc_feature (108)..(321): Pfam Name: Abhydrolase_3 Pfam Description: alpha/beta hydrolase fold
  misc_feature (89)..(197): Pfam Name: COesterase Pfam Description: Carboxylesterase
  misc_feature (1)..(344): Functional Homolog Of SEQ ID NO. 99
MAGSNEVNLNESRRVVPLNTWVLISNFKLAYNLQRRPDGTFNRDLSEFLDRKVPANINPVDGVFSFDHVDGGTGLLNRVYQPSSQNEAQWGIVDLEKPLSTTEIVPVIVFFHGGSFTHSSANSAIYDTFCRRVVSFCKAVVVSVNYRRSPEHRYPCAYDDGWAALKWVKSRTWLQSGKDSKVYVYLAGDSSGGNIAHHVAVRAAEADVEVLGNILLHPMFGGQRRTESEKRLDGKYFVTLLDRDWYWRAYLPEGEDRDHPACNPFGPRGKSLKGLKFPKSLLVVAGLDLIQDWQLAYVEGLRRSGQEVKLLFLEKATIGFYFLPNNDHFYCLMEEIKNFVTSNC

SEQ ID NO: 1049 - protein, 360 aa, Oryza sativa Japonica Group
  misc_feature (1)..(360): Public GI ID no. 115467742
  misc_feature (1)..(360): Bit score of 243.8 for HMM based on sequences of FIGURE 2.
  misc_feature (101)..(329): Pfam Name: Abhydrolase_3 Pfam Description: alpha/beta hydrolase fold
  misc_feature (78)..(143): Pfam Name: COesterase Pfam Description: Carboxylesterase
  misc_feature (1)..(360): Functional Homolog Of SEQ ID NO. 99
MADAHGHRRRVALPCAVRLRLCLLEAAIDATQRRDGAINRPLFSLYDRRAPADPRPDAAGVSSTDVTVDASRGLWARVFTPTAPEHEHSSSSSTTTPRPVIVYFHGGGFAMFSAASRPFDTHCRTLCAGVGAVVVSVDYRLAPEHRFPAAYDDGEAVLRYLATTGLRDEHGVPVDLSACFLAGDSAGGNIAHHVAQRWTTTSAATPPPPSDNPVHLAGVILLEPYFGGEERTKAERALEGVAPVVNIRRSDRWWRAFLPEGADRNHPAAHVTGDAGPEPELQEAFPPAMVVVGGLDPLQDWDRRYAGMLRRKGKAVRVVEFPEAIHAFYFFPEFAGDIRKLVGEIRAFVEDSIMSKQSIA

SEQ ID NO: 1050 - protein, 350 aa, Medicago truncatula
  misc_feature (1)..(350): Public GI ID no. 357510077
  misc_feature (1)..(350): Bit score of 627.5 for HMM based on sequences of FIGURE 2.
  misc_feature (109)..(327): Pfam Name: Abhydrolase_3 Pfam Description: alpha/beta hydrolase fold
  misc_feature (105)..(149): Pfam Name: COesterase Pfam Description: Carboxylesterase
  misc_feature (1)..(350): Functional Homolog Of SEQ ID NO. 99
MTGTNEVNLSESRSVVPLNTYVLISNFKLAYNLLRRADGTFNRDLAEFLDRKVPANAIPVDGVFSFDHIERNTGLFNRVYLPSSSENESQWGVKDLEKPLSTTEIVPVIVFFHGGSFSHSSANSAIYDTFCRRLVSVCKAAVVSVNYRRSPEYRFPCAYEDGWNALKWVKSRKWLQSGKEKKVYVYMAGDSSGGNIVHHVAVKACEEKAEGIEVLGNILLHPLFGGEKRTDSEMRLDGKYFVRLQDRDWYWRAFLPEGEDRDHPACNPFGPKGEKNLKGLDKFPKSLVCVAGLDLLQDWQLAYVDGLRNFGQDVKLLYLKEATIGFYFLPNNDHFYCLMEEIKNFVNPNC

SEQ ID NO: 1051 - protein, 378 aa, Selaginella moellendorffii
  misc_feature (1)..(378): Public GI ID no. 302823479
  misc_feature (1)..(378): Bit score of 438.7 for HMM based on sequences of FIGURE 2.
  misc_feature (116)..(339): Pfam Name: Abhydrolase_3 Pfam Description: alpha/beta hydrolase fold
  misc_feature (104)..(155): Pfam Name: COesterase Pfam Description: Carboxylesterase
  misc_feature (1)..(378): Functional Homolog Of SEQ ID NO. 99
MLLQSEHMEPEEDSSAEELQLKESKEVVPLNTWVLISNLKLAYNLTRNSDGSFNRNLDEFLDRKVPVSSVEREDDPVTFMDVTIDRTSGIWSRIFIPRASHNNNASSTTHGTPIFFYFHGGSFVHMSANSAVYHTVCQQLARLCQAVVISVNYRRAPEHKYPAAYNDCYAALTWLKVQVLRGVAHAWLPRTADLGRCFLVGDSNGGNIVHHVGVRAAESGAELGPLRVAGHILIIPMFGGNRRTQSELRFDGQYFVTIKDRDFYWQSFLPAGADRDHPACNIFGPSSRSLEGVVLPPSLVAVAGLDMIKDWQLQYVEGMRNAGKDVELLFLEEATVGFFIFPNTGHFHRLMDKITAFIDRDGDQHLTRRTGITRRTTT

SEQ ID NO: 1052 - protein, 360 aa, Medicago truncatula
  misc_feature (1)..(360): Public GI ID no. 357442625
  misc_feature (1)..(360): Bit score of 662.5 for HMM based on sequences of FIGURE 2.
  misc_feature (124)..(337): Pfam Name: Abhydrolase_3 Pfam Description: alpha/beta hydrolase fold
  misc_feature (120)..(163): Pfam Name: COesterase Pfam Description: Carboxylesterase
  misc_feature (1)..(360): Functional Homolog Of SEQ ID NO. 99
MRRHKRAKKTNIIDINMAGSNEVNLNESKSVVPLNTWVLISNFKLAYNLLRRADGTFNRELAEFLDRKVPANTIPVDGVFSFDHVDRNSGLFNRVYQPAPENVTTWGIIELEKPLSTTEIVPVIIFFHGGSFSHSSANSAIYDTFCRRLVSMCKAVVVSVNYRRSPEHRYPCAYEDGWNALNWVKSRTWLQSGKDSKVYAYMAGDSSGGNIAHHVAVRAAEEDVEVLGNILLHPLFGGEKRTESEKKLDGKYFVRLQDRDWYWRAFLPEGEDRDHPACNPFGPKGKSLVGLKFPKSLVCVAGLDLLQDWQLEYVEGLENSDQDVKLLYLKEATIGFYFLPNNDHFYCLMNEINTFVHPNC

SEQ ID NO: 1053 - protein, 343 aa, Medicago truncatula
  misc_feature (1)..(343): Public GI ID no. 357498883
  misc_feature (1)..(343): Bit score of 268.9 for HMM based on sequences of FIGURE 2.
  misc_feature (100)..(316): Pfam Name: Abhydrolase_3 Pfam Description: alpha/beta hydrolase fold
  misc_feature (93)..(141): Pfam Name: COesterase Pfam Description: Carboxylesterase
  misc_feature (1)..(343): Functional Homolog Of SEQ ID NO. 99
MSDSTPLLPWKARATISLLSLLFDASSRSNGTVNRRLFNFFSLNASPNSTPVNGVSTKDITVNTENNVWFRLFTPTVAGEVAGEVTGDGGATKTTSLPVIIYFHGGGFSFLSPSSIYHDALCRRLCREVFAVVVSVNYRLTPEHRYPSQYDDGEAVLKFLEENKTVLPENADVSKCFLAGDSSGANLAHHLTVRVCKAGLREIRIIGLVSIQPFFGGEERTEAEIKLDGSPLVSMARTDWWWKVFLPEGSNRDHGAVNVSGPNAEDLSGLDFPETIVFIGGFDPLNDWQKRYYNWLKKCGKKAELIEYPNMVHVFYIFPDLPESTQLIMQVKDFISKVSNSRL

SEQ ID NO: 1054 - DNA, 1290 bp, Panicum virgatum
  misc_feature (1)..(1290): Ceres Clone ID no. 1911189
  misc_feature (1)..(1290): Encodes the peptide sequence at SEQ ID NO. 1055
agattcagtactccgtagctagattcagctaagagcgaggcgcgagatggcagggggcgcagggcaggacgcggcgcgcgcgccgccggcgctaccgtggacggtgcgtctccagctcttcggcatcgtgacggccgccggcgccacgatgcggcgcgacggcacgatcaaccgcttcgtctacaacctcctcgaccgccgggtccgcgccagagcgcggccggacgggtccggcgtccggtccgccgacgtcggcgtcggcgcgccgcgcggcctgtgggcgcgcgtcttctcgccgtcgggggcggccggggcgccgctccccgtgctcatctacttccacggcggcggcttcgcgctgctctcggcggcctcggccccctacgacgccatgtgccgccggttctgccgcgagctcggcgccgtcgtcgtgtccgtcaactaccgcctcgcgcccgagcaccgctgccccgccgcctacgacgacggcgtggacatgctccgctacctcgcatccaccggcctcccaggcatctctgttccggtggacttctcccgatgcttcctcaccggggacagcgccggcggcaacatcgcccaccacgtggcgcgacgctggacggcaagcaccacctcctcagagtcgccgcctccgtccaacccaattcgcctcgctggcatcatcctggtgcagccgtactttggcggcgagcagcggacggacacggagctgaggctggacggcaaggcgccggtgctgaccatgcggggctcggactgggcgtggacggcgttcctgccggagggcgccgaccggaaccaccccgccgcgcacgtgaccgacgagaacgccggcctggacgacggcttcccgcctgcgatggtggtgatcggcgggctggacctgctacaggactggcagcggcggtacgccgacgtgctgcggcggaaggggaaagcggtgcgggtggtggagtacccggaggccattcacacgttctacttgttccccgtgctccccgactccggcaggctcgtcgaggagatgaaagcgttcatggaagagagcaacgcgtccgagctgactacttgatcaccgcttcgtcagttgaaatgcctcaatctagatctagctgtaagtgtattgccgttgctttatgtcgtttgtagttttgatcgtgtgacatatgagtgtaataggattagggtaatttagcagtcacttaatagttgcgttgtgtaaaggtggcaatgtatttcttttagcctagtggacatactactcagtcc

SEQ ID NO: 1055 - protein, 348 aa, Panicum virgatum
  misc_feature (1)..(348): Ceres Clone ID no. 1911189
  misc_feature (1)..(348): Bit score of 232.1 for HMM based on sequences of FIGURE 2.
  misc_feature (95)..(319): Pfam Name: Abhydrolase_3 Pfam Description: alpha/beta hydrolase fold
  misc_feature (81)..(137): Pfam Name: COesterase Pfam Description: Carboxylesterase
  misc_feature (1)..(348): Functional Homolog Of SEQ ID NO. 99
MAGGAGQDAARAPPALPWTVRLQLFGIVTAAGATMRRDGTINRFVYNLLDRRVRARARPDGSGVRSADVGVGAPRGLWARVFSPSGAAGAPLPVLIYFHGGGFALLSAASAPYDAMCRRFCRELGAVVVSVNYRLAPEHRCPAAYDDGVDMLRYLASTGLPGISVPVDFSRCFLTGDSAGGNIAHHVARRWTASTTSSESPPPSNPIRLAGIILVQPYFGGEQRTDTELRLDGKAPVLTMRGSDWAWTAFLPEGADRNHPAAHVTDENAGLDDGFPPAMVVIGGLDLLQDWQRRYADVLRRKGKAVRVVEYPEAIHTFYLFPVLPDSGRLVEEMKAFMEESNASELTT

SEQ ID NO: 1056 - protein, 364 aa, Malus domestica
  misc_feature (1)..(364): Bit score of 650.7 for HMM based on sequences of FIGURE 2.
  misc_feature (128)..(341): Pfam Name: Abhydrolase_3 Pfam Description: alpha/beta hydrolase fold
  misc_feature (111)..(168): Pfam Name: COesterase Pfam Description: Carboxylesterase
  misc_feature (1)..(364): Functional Homolog Of SEQ ID NO. 99
  misc_feature (96)..(96): Xaa is any aa, unknown, or other
MCWVFFKRRFWSGNSSEPVSMAGGNEVNVNESRTVVPLNTWVLISNFKLSYNLLRRPDGTFNRHLAEFLDRKVPANAKPVDGVVSFDVIIDRETSXLSRIYHPDNADLSPLNIVDLKRPVNKEVLPVIVFFHGGSFVHSSSNSGIYDILCRRLVGVCKAVVVSVNYRRAPENRYPCAYDDGWTALKWVKSRPWLKSTKDSKVHIYLAGDSSGGNIVHNVALRAVEFGINVLGNILLNPMFGGQERTESEMRLDGKYFVTIQDRDWYWRALLPEGEDRDHPACNPFGPRGQSLEAVKFPKSLIVVAGLDLIQDWQLAYARGLERAGINVKLMYLEHATIGFYLLPNNEHFYTVMDEISKFVCSDY

SEQ ID NO: 1057 - protein, 338 aa, Glycine max
  misc_feature (1)..(338): Public GI ID no. 356559967
  misc_feature (1)..(338): Bit score of 283.1 for HMM based on sequences of FIGURE 2.
  misc_feature (92)..(307): Pfam Name: Abhydrolase_3 Pfam Description: alpha/beta hydrolase fold
  misc_feature (76)..(133): Pfam Name: COesterase Pfam Description: Carboxylesterase
  misc_feature (1)..(338): Functional Homolog Of SEQ ID NO. 99
MASETPKAKAVLPWTTRVSISFLSTLTDFSRRSNGTVNRRLMNFLDRKTQANAKPVKGVSTKDVTVDAKRNLWFRIYNPTAADADDGLPVFIFFHGGAFAFLSPDSFAYDAVCRRFCRRIPAVVVSVNYRLAPEHRYPSQYDDGEDILRFLDENRAVLPDNADLSKCFLAGDSAGANLAHNVAVRIGKSGLQLIRVVGLVSIQPWFGGEERTAAEVKLDGAPLVSMARTDWLWKAFLPEGSDRDHGAANVSGPNSEDLSGLYYPDTLLFVGGFDPLQDWQKKYYEWLKKSGKNAQLIEYPSSIHAFYIFPELPESSQLISQVKDFVTKKISDFQSNVY

SEQ ID NO: 1058 - protein, 344 aa, Prunus persica
  misc_feature (1)..(344): Bit score of 688.4 for HMM based on sequences of FIGURE 2.
  misc_feature (108)..(321): Pfam Name: Abhydrolase_3 Pfam Description: alpha/beta hydrolase fold
  misc_feature (103)..(147): Pfam Name: COesterase Pfam Description: Carboxylesterase
  misc_feature (1)..(344): Functional Homolog Of SEQ ID NO. 99
MAGSNEVNVNESKRVVPLNTWVLISNFKLAYNLLRRADGTFNRELAEFLDRKVPANTIPVDGVFSFDHVDRGTGLLNRVYLQAPENEAQWGIVDLEKPLSTTKIVPVIIFFHGGSFTHSSANSAIYDTFCRRLVNTCKAVVVSVNYRRSPEHRYPCAYDDGWATLKWVKSRTWLRSGKDSKVHVYLAGDSSGGNIAHHVAVKAAEAEVEVLGNILLHPMFGGQKRTESEKRLDGKYFVTIQDRDWYWRAFLPEGEDRDHPACNIFGPRDKSLEGLKFPKSLVVVAGFDLVQDWQLAYVEGLKNSGQDVKLLYLKQATIGFYFLPNNEHFYCLMEEISNFVNPDC

SEQ ID NO: 1059 - protein, 334 aa, Ricinus communis
  misc_feature (1)..(334): Public GI ID no. 255574873
  misc_feature (1)..(334): Bit score of 251.5 for HMM based on sequences of FIGURE 2.
  misc_feature (88)..(306): Pfam Name: Abhydrolase_3 Pfam Description: alpha/beta hydrolase fold
  misc_feature (75)..(130): Pfam Name: COesterase Pfam Description: Carboxylesterase
  misc_feature (1)..(334): Functional Homolog Of SEQ ID NO. 99
MTQDLQNLDIPWKIRLSMYALCLGFDISRRSNGTINRFLMNFFDFKSFPSKKPINGVSTTDVSVDKARNLWFRLYTPTPAGDTTMPVIFYFHGGGFCYMSPHSRPYNYFCDQLARELSAIIISVNYRLAPKHRYPAQYEDCFDTIKFIDETGVEGFPSHANLKHCFLAGDSAGGNIVYHVMVRARKHEFRSIKLIGAMLIQPFFGGEERTESEITLDGQVPFVNIERTDWMWKAFLPEGSDRDHPAANVSGCNSVDISGLEFPASVIFVAGFDPLKDWQKRYYEGLKKYGKEAYLIEYPDTFHAFYAYPELPVSSLLIKDMKDFMQKQLLAANK

SEQ ID NO: 1060 - protein, 320 aa, Vitis vinifera
  misc_feature (1)..(320): Public GI ID no. 225460002
  misc_feature (1)..(320): Bit score of 264.9 for HMM based on sequences of FIGURE 2.
  misc_feature (86)..(298): Pfam Name: Abhydrolase_3 Pfam Description: alpha/beta hydrolase fold
  misc_feature (73)..(171): Pfam Name: COesterase Pfam Description: Carboxylesterase
  misc_feature (1)..(320): Functional Homolog Of SEQ ID NO. 99
MWPPNLPWKVRLFVTAFGFLTDASFRRNGSVNRRFINLIDFKISPSDKPVNGVTTSDITVDPSRNLWFRYFLPSAAEAGKKLPVTVYFHGGGFVMLSPSSQLFDDLCRRLAKELPAVIVSVNYRLAPEHRCPASYEDGVDVLKFLDENPPANADLTRCYIVGDSAGGNIAHHVTARAGEHNFTNLNIAGVIPIQPYFGGEERTESEIQLAGAPLVSVERTDWCWKAFLPEGSDRDHPAANVFGPKSSDVSGLKFPKSLVFMGGFDPLRDWQESYCEGLKGNGKEVKVVDYPNAMHSFYAFPDLPESTLFMRELQDFIYPQ

SEQ ID NO: 1061 - protein, 332 aa, Prunus persica
  misc_feature (1)..(332): Bit score of 645.4 for HMM based on sequences of FIGURE 2.
  misc_feature (96)..(309): Pfam Name: Abhydrolase_3 Pfam Description: alpha/beta hydrolase fold
  misc_feature (79)..(137): Pfam Name: COesterase Pfam Description: Carboxylesterase
  misc_feature (1)..(332): Functional Homolog Of SEQ ID NO. 99
MTVVPLNTWVLISNFKLSYNLLRRPDGTFNRHLAEFLDRKVPANAKPVDGVVSFDVIIDRETGLLTRIYQPANAEESVLNILNLDKPVSNEVVPVIIFFHGGSFAHSSANSGIYDILCRRLVGICKAVVVSVNYRRAPENRFPCAYDDGWTALQWVNSRSWLKSTKDSKVHIYLAGDSSGGNIVHNVALRAVESGIDVLGNILLNPMFGGQERTESEKRLDGKYFVTIQDRDWYWRAFLPEGEDRDHPACNPFGPRGNNLEAIKFPKSLVVVAGLDLVQDWQLAYAKGLEKAGKNIKLMYLEQATIGFYLLPNNDHFYTVMDEISKFVCSNC

SEQ ID NO: 1062 - protein, 310 aa, Populus trichocarpa
  misc_feature (1)..(310): Public GI ID no. 224056763
  misc_feature (1)..(310): Bit score of 269.4 for HMM based on sequences of FIGURE 2.
  misc_feature (68)..(285): Pfam Name: Abhydrolase_3 Pfam Description: alpha/beta hydrolase fold
  misc_feature (53)..(110): Pfam Name: COesterase Pfam Description: Carboxylesterase
  misc_feature (1)..(310): Functional Homolog Of SEQ ID NO. 99
MIRRSDGSLNRLLLNFLDYKTSPSPDKPIDGVTTTDFTIDEDRNLWFRLYNPVFRTSTTDNEVNIPVIFYFHGSGFVCMAANSKLFDDLCYRLARLLPAVIISVNYRLAPEHRYPCQYEDGFDVIKFIDISYLEVLPNHANLKHSFVAGDSAGGNLAHHMALKASKYELSNIKLNGVIAIQPFFGGEERTGSEIKLSRDPIVPMDTTDWMWRSFLPEGSNRDHQVSNVFGPNSVDISELEFPAVLVIIGGLDPLQDWQKRYCEGLKKSGKEVYLVEYDNAFHSFYLFPCVPEFSLFIKEVKDFMQKQMSR

SEQ ID NO: 1063 - protein, 356 aa, Selaginella moellendorffii
  misc_feature (1)..(356): Bit score of 429.1 for HMM based on sequences of FIGURE 2.
  misc_feature (94)..(317): Pfam Name: Abhydrolase_3 Pfam Description: alpha/beta hydrolase fold
  misc_feature (82)..(133): Pfam Name: COesterase Pfam Description: Carboxylesterase
  misc_feature (1)..(356): Functional Homolog Of SEQ ID NO. 99
MAQEVVPLNTWVLISNLKLAYNLTRNSDGSFNRNLDEFLDRKVPVSSVEREDDPVTFMDVTIDRTSGIWSRIFIPRASHNNNASSTTHGTPIFFYFHGGSFVHMSANSAVYHTVCQQLARLCQAVVISVNYRRAPEHKYPAAYNDCYAALTWLKVQVLRGVAHAWLPRTADLGRCFLVGDSNGGNIVHHVGVRAAESGAELGPLRVAGHILIIPMFGGNRRTQSELRFDGQYFVTIKDRDFYWQSFLPAGADRDHPACNIFGPSSRSLEGVVLPPSLVAVAGLDMIKDWQLQYVEGMRNAGKDVELLFLEEATVGFFIFPNTGHFHRLMDKITAFIDRDGDQHLTRRTGITRRTTT

SEQ ID NO: 1064 - protein, 351 aa, Oryza sativa Japonica Group
  misc_feature (1)..(351): Public GI ID no. 297611539
  misc_feature (1)..(351): Bit score of 243.9 for HMM based on sequences of FIGURE 2.
  misc_feature (99)..(325): Pfam Name: Abhydrolase_3 Pfam Description: alpha/beta hydrolase fold
  misc_feature (93)..(138): Pfam Name: COesterase Pfam Description: Carboxylesterase
  misc_feature (1)..(351): Functional Homolog Of SEQ ID NO. 99
MEKPTKKGVAPPMAWRTRLSILAAGCLTDATCRADGTINRRLLNFLDPHVPPSAAPRNGVASRDVVVDPAIPLRARLFYPCPSGGDGGTGDATKPLPVVVFFHGGGFAYLSAASRAYDAACRRIARYAGAAVLSVDYRRSPEHRYPTPYDDGLAALRFLDDPNNHPLAADDGDVPPLDVTRCFVAGDSAGANIAHHVARRYALASTTFANLRLAGLIAIQPFFGGEERTPAELRLVGAPIVSVPRTDWLWRAFLPPGADRTHEAAHAASPAGAAGIDSPAFPPATVVIGGYDPLQDWQRRYCETLRGKGKAVRVLDYPDAIHAFYIFPEFAEARDLMLRIKDIVAGGGGEH

SEQ ID NO: 1065 - DNA, 1460 bp, Panicum virgatum
  misc_feature (1)..(1460): Ceres Clone ID no. 1815446
  misc_feature (1)..(1460): Encodes the peptide sequence at SEQ ID NO. 1066
aatctgctccacgcctatcactgttcactgctcggtatcgtctgcaactgcaacgccgggagcttgagcttgagagagagagaagctagcatgacgaagacgcaaggaaccggagccgcggcgccgcgcgcgccggcgctgccgtggacggtgcggttccgcatcttcgccctcgtcaccgccaccgacatcgcgcagcggcccgacggcacggtcaaccgcttcatggtctcgctcgccgaccgccaggcccgcgccagcgcgcggccggacgggctcggcgtcgtgtccgccgacgtcgacgtcgacgcgtcgcgcggcctgtgggcgcgcgtgttctcgccgtcgtcgtccgtcgtcgaccccgcggcgcccgcgctccccgtggtggtctacttccacggcggcggcttcacgctgctctccgcggcgtcggccctctacgacggcatgtgccgccagttctgcagcgagctcggtgccgtcgtggtgtccgtgaactaccgcctcgcgcccgagcaccggttccccgccgcctacgacgacggcgtggacgtgctccggtacctcgggagcgccggcctccccgacctcggcgtcccggtcaacctctcccgctgcttcctcgccggggacagcgccggcggcaacctcacccaccacgtcgcgcagcgctggacggacaccgcctccgcccccatccgcatcgccggtatcatcctgctgcagccgtacttcggcggcgaggagcgcacgccggccgagctgagactggagggcgtggcgccagtggtgaacatgcggcgctcggactggtcgtggcgggcgttcctgccggagggggccaaccggaaccaccctgctgcgcacgtcaccggcgaggccgccccggagcccgagctggcggaggcgttcccgccggcgatggtggtgatcggcgggatggacccgctgcaggactggcagcggcggtacgccgccatgctggagcggaaagggaaggccgtgcaggtcctggagttcccggaggccatccacgcgttctacgtgttccccgagctcgccgactccggcaaggtcgtgaaggcgatcaaggcgttcatggatgagccgagggcagcacatcccagccagctcctcagctgctgatccatcgtcgtcgtgcctacaacttgtcgaccggtggtggaggtccgtcgcatagccctcctgcgacgaacacatcatcggaaaacaccagcggtggacagagcagctccaggcccccaacgacgtcaaaaagcagtagaagagagcgtcttttggtgcacatggatcttgtttatctatcatgcactactgtaatttgaattattcttgtagtagacttgtaatgtgtactttgtggtcatgtattagtactactattattagacgtgtaatggaccacactttgtgcaatcgagtatattgtaatgtcc

SEQ ID NO: 1066 - protein, 352 aa, Panicum virgatum
  misc_feature (1)..(352): Ceres Clone ID no. 1815446
  misc_feature (1)..(352): Bit score of 241.4 for HMM based on sequences of FIGURE 2.
  misc_feature (100)..(319): Pfam Name: Abhydrolase_3 Pfam Description: alpha/beta hydrolase fold
  misc_feature (96)..(142): Pfam Name: COesterase Pfam Description: Carboxylesterase
  misc_feature (1)..(352): Functional Homolog Of SEQ ID NO. 99
MTKTQGTGAAAPRAPALPWTVRFRIFALVTATDIAQRPDGTVNRFMVSLADRQARASARPDGLGVVSADVDVDASRGLWARVFSPSSSVVDPAAPALPVVVYFHGGGFTLLSAASALYDGMCRQFCSELGAVVVSVNYRLAPEHRFPAAYDDGVDVLRYLGSAGLPDLGVPVNLSRCFLAGDSAGGNLTHHVAQRWTDTASAPIRIAGIILLQPYFGGEERTPAELRLEGVAPVVNMRRSDWSWRAFLPEGANRNHPAAHVTGEAAPEPELAEAFPPAMVVIGGMDPLQDWQRRYAAMLERKGKAVQVLEFPEAIHAFYVFPELADSGKVVKAIKAFMDEPRAAHPSQLLSC

SEQ ID NO: 1067 - protein, 332 aa, Actinidia deliciosa
  misc_feature (1)..(332): Public GI ID no. 82697971
  misc_feature (1)..(332): Bit score of 249.5 for HMM based on sequences of FIGURE 2.
  misc_feature (87)..(308): Pfam Name: Abhydrolase_3 Pfam Description: alpha/beta hydrolase fold
  misc_feature (79)..(178): Pfam Name: COesterase Pfam Description: Carboxylesterase
  misc_feature (1)..(332): Functional Homolog Of SEQ ID NO. 99
MASETKSAPILPWKTRLLVARLTFACNYTRRSNGTVNRLLMNFLDAKSPPTPKPMNGVTSSDITVDVSRNLWFRLFTPADADTLPVIVYFHGGGFVFFSASTKPYDEFCRRLAENIPAVVVSVNYRLAPEHRFPAQFDDAFDALKFLDANFLPPNADLSRCFIAGDSAGGNIAHQVALRSAAADADADAGFRRLRIAGVIAIQPFFGGEERTESELRLTHMPILNMELSDWMWKAFLPEGSNRNHEGVNFLSDPKSAHISGLNFPATMVFVGGFDPLQDLQRKYYDWLKKSRKEAYLVEYPQAIHAFYAFPELPEASQLLTDVRDFIQKQCQ

SEQ ID NO: 1068 - protein, 329 aa, Ricinus communis
  misc_feature (1)..(329): Public GI ID no. 255564916
  misc_feature (1)..(329): Bit score of 235.6 for HMM based on sequences of FIGURE 2.
  misc_feature (82)..(299): Pfam Name: Abhydrolase_3 Pfam Description: alpha/beta hydrolase fold
  misc_feature (71)..(124): Pfam Name: COesterase Pfam Description: Carboxylesterase
  misc_feature (1)..(329): Functional Homolog Of SEQ ID NO. 99
MSSKSLPWRIRVPLFIFSTAVAACCRKNYTINRRIWNFFDAKSPPSETPRDGVKTSDIIIDATRNLWLRLYIPTSTTTMPVVIYMHGGGFSFFTADTMACEISCRRLASELNAIIISISYRLAPEFKFPCQYEDCFDALKFIDANLGDILPPFADQNMCFLIGDSAGRNLIHHTAVKASGSGFLRLKVIGLISIQPFFGGEERTESETRLAGAPVLNVELTDWFWKAFLSDGSDRDHPLCNVFGPNSNDISDVNLPAMLLVIGGFDILQDWQRKYHEWMRKAGKEVNLVEFPNAFHGFWGFPDLPEYPLFIEEVKDFMQKQSAKRHFLF

SEQ ID NO: 1069 - protein, 364 aa, Malus domestica
  misc_feature (1)..(364): Bit score of 651.0 for HMM based on sequences of FIGURE 2.
  misc_feature (128)..(341): Pfam Name: Abhydrolase_3 Pfam Description: alpha/beta hydrolase fold
  misc_feature (113)..(168): Pfam Name: COesterase Pfam Description: Carboxylesterase
  misc_feature (1)..(364): Functional Homolog Of SEQ ID NO. 99
  misc_feature (96)..(96): Xaa is any aa, unknown, or other
  misc_feature (111)..(111): Xaa is any aa, unknown, or other
MCWVFFKRRFWSGNSSEPVSMAGGNEVNVNESRTVVPLNTWVLISNFKLSYNLLRRPDGTFNRHLAEFLDRKVPANAKPVDGVVSFDVIIDRETSXLSRIYHPDNADLSPXNIVDLKRPVNKEVLPVIVFFHGGSFVHSSSNSGIYDILCRRLVGVCKAVVVSVNYRRAPENRYPCAYDDGWTALKWVKSRPWLKSTKDSKVHIYLAGDSSGGNIVHNVALRAVEFGINVLGNILLNPMFGGQERTESEMRLDGKYFVTIQDRDWYWRALLPEGEDRDHPACNPFGPRGQSLEAVKFPKSLIVVAGLDLIQDWQLAYARGLERAGINVKLMYLEHATIGFYLLPNNEHFYTVMDEISKFVCSDY

SEQ ID NO: 1070 - protein, 332 aa, Vitis vinifera
  misc_feature (1)..(332): Public GI ID no. 225459998
  misc_feature (1)..(332): Bit score of 265.7 for HMM based on sequences of FIGURE 2.
  misc_feature (91)..(304): Pfam Name: Abhydrolase_3 Pfam Description: alpha/beta hydrolase fold
  misc_feature (77)..(133): Pfam Name: COesterase Pfam Description: Carboxylesterase
  misc_feature (1)..(332): Functional Homolog Of SEQ ID NO. 99
MAGSEVRTSPELPLKLRLSLAIFSAVSKVSLRRNGTVNRCLMSLVDFKSSTNKKPIKGVTTSDTTVDSSRNIWFRAYRPREAASGENLPMIVYFHGGGFALLAANSKPYNDLCLRLSRKLPAIVVSVNYRLSPDHRYPSQYDDGFDALKFLDDNPPANADLTRCFIAGDSAGGNLAHHVTARAGEFEFRNLKILGVIPIQPFFGGEERTESETQLARAPVLSMKLTDWYWRAFLPEGSDRDHAAANVFGPKSSGISGVKFPKSLVFIGGFDPLKEWQKRYCEGLKMSGNEVKVVEYGNGIHGFYVFPELPESGLMVEEVREFMKERTGFGDQ

SEQ ID NO: 1071 - protein, 294 aa, Allium cepa
  misc_feature (1)..(294): Public GI ID no. 169159268
  misc_feature (1)..(294): Bit score of 489.6 for HMM based on sequences of FIGURE 2.
  misc_feature (57)..(271): Pfam Name: Abhydrolase_3 Pfam Description: alpha/beta hydrolase fold
  misc_feature (32)..(97): Pfam Name: COesterase Pfam Description: Carboxylesterase
  misc_feature (1)..(294): Functional Homolog Of SEQ ID NO. 99
MERKVPANATPVNNVISFDIILDRSVNLLARIYRPTPPSTSFLDLHSRPSISPFPVILFFHGGSFAHSSSNSAIYDSLCRRLVSLLGPSVVISVNYRRSPEHRYPAPYDDGWTALKWAYNESWLRAGLDTKPSIFLVGDSSGGNIAHNVALRAADSEFDISGNIVLNPMFGGNERTESERKYDGKYFVTIQDRDWYWKAFLPEGEDRETPGCNPFGPRGVKLEDIRFPKCLVIVAGLDLLSDWQLAYAEGLRKAGKDVKLVYREQATVGFYFLPNTEHFYEVMDEIKEFVTSNC

SEQ ID NO: 1072 - protein, 344 aa, Arabidopsis thaliana
  misc_feature (1)..(344): Public GI ID no. 215261125
  misc_feature (1)..(344): Bit score of 643.6 for HMM based on sequences of FIGURE 2.
  misc_feature (109)..(322): Pfam Name: Abhydrolase_3 Pfam Description: alpha/beta hydrolase fold
  misc_feature (80)..(148): Pfam Name: COesterase Pfam Description: Carboxylesterase
  misc_feature (1)..(344): Functional Homolog Of SEQ ID NO. 99
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAE

SEQ ID NO: 1073 - protein, 342 aa, Glycine max
  misc_feature (1)..(342): Public GI ID no. 356500238
  misc_feature (1)..(342): Bit score of 652.8 for HMM based on sequences of FIGURE 2.
  misc_feature (106)..(319): Pfam Name: Abhydrolase_3 Pfam Description: alpha/beta hydrolase fold
  misc_feature (102)..(147): Pfam Name: COesterase Pfam Description: Carboxylesterase
  misc_feature (1)..(342): Functional Homolog Of SEQ ID NO. 99
MTGSNEVNLSESKSVVPLNTWVLISNFKLAYNLLRRADGTFNRELAEFLDRKVPANAIPVDGVFSFDHVERSTGLFNRVYQLAPENMGRFIELEKPLSTTEIVPVIIFFHGGSFSHSSANSAIYDTFCRRLVNNCKAVVVSVNYRRSPEYRYPCAYDDGWAALNWVKSRTWLQSGKDSKVHVYLAGDSSGGNIAHHVAVRAAEEDIEVLGNILLHPLFGGEKRTESETKLDGKYFVRLQDRDWYWRAFLPEGTDRDHPACNPFGPKGKNLEGLKFPKSLVCVAGLDLLQDWQVEYVEGLKNCGQDVNLLYLKEATIGFYFLPNNDHFYTLMEEIKNFVNPNC

SEQ ID NO: 1074 - protein, 415 aa, Theobroma cacao
  misc_feature (1)..(415): Bit score of 684.7 for HMM based on sequences of FIGURE 2.
  misc_feature (108)..(321): Pfam Name: Abhydrolase_3 Pfam Description: alpha/beta hydrolase fold
  misc_feature (81)..(147): Pfam Name: COesterase Pfam Description: Carboxylesterase
  misc_feature (1)..(415): Functional Homolog Of SEQ ID NO. 99
MAGSNEVNLNECKMVVPLNTWVLISTYKLAYNLLRRPDGTFKRHLAEFLDRKVPANANPVDGVFSFDVIIDRSTSLFSRIYRPATAEEPQPNIVELEKPVMAEVVPVIIFFHGGSFAHSSANSAIYDTLCRRLVGVCKAVVVSVNYRRAPENRYPSAYDDGWTALKWVNSRSWLQSQKDSKVHIYLAGDSSGGNIAHHVAAQAVESGIDVLGNILLNPMFGGQERTESEKRLDGKYFVTLQDRDWYWRAFLPEGEDRDHPACNPFGPNGKSLEGIKFPKSLVVVAGLDLVQDWQMAYVEGLKNAGQEVKLLYLDQATIGFYLLPNNNHFHTVMGEISKFVKYRPWLYGEEEVFQHIAGSGCVLVCIQSPGLGVLWFDEASAAVMFSRPLNFKNYKFWLLATKEKKTGNIWITFGT

SEQ ID NO: 1075 - DNA, 1231 bp, Triticum aestivum
  misc_feature (1)..(1231): Ceres Clone ID no. 1448852
  misc_feature (1)..(1231): Encodes the peptide sequence at SEQ ID NO. 1076
cccctctcggtccaactcgaaacaacgcacgcgaacgcagccatggcggatttgaaggctccggccaaggcgaggaggctggcaccgcccatgtcgtggcggacacgcctgtcaatcttcgccgccggttacctcaccgacgccacctgccgcgctgacggcacaatcaaccgccgcctgctcacctacctcgaccccggcgtcccgccctccgccgccccgcgcaacggcgtctcctcccgcgacatcgacgtcgacgccgcgatcccgctccgggcccgcctcttccaccccgtgggcctgcccggcccgctcccggttgtcctgttcttccacggcggcgggttcgcctacctctccgcggcctccctcgcctacgatgccgcgtgccgccgcatcgccaggtactgcggcgcggccgtgctgtcggtcgactaccgccgctctccggagcaccggttcccggcggcgtacgacgacgggttctccgcgctccgcttcctcgacgaccccaacaagcaccccgccgacgtcgcgcccctcgacgtctcccgctgcttcgtcgccggggacagcgcaggcgccaacatcgcccaccacgtcgcccgccgctacgccatgtcctccccgtccttcgccaacgtccggatctccggcctcatcgccatccagcccttcttcggcggcgaggagcggaccccctccgagctccagctggagggcgcgcccatcgtgtccatctcccgctgcgactggatgtggcgcgccttcctcccgcccggtgccgaccggacgcacgaggccgcgcacgcggcgtcccctgcggccgcggccggcatcgactccccggcgttcccgccggcggtggtggttgtcggcgggtacgacccgctccaggattggcagcggcggtactgcgagatgctgacctccaagggaaaggaggtgcgggtgctggagtaccccgaagccatccacgccttttatgtcttcccggagttcgccgagtccaaggacctcatgctgaggatcaaggagttcgtcgccgggagcgacggcagcaagtgagcagctcgcgccagtatcttcagtgtcagtgtttgcgtgtgtggtcggaattaggagaagaggattgggtgtgctggcatgacgtatctggacgagagtactcgtagtgaactactgtagtagggaagtacggatgacgacgtgtaagaagtgttattcttac

SEQ ID NO: 1076 - protein, 341 aa, Triticum aestivum
  misc_feature (1)..(341): Ceres Clone ID no. 1448852
  misc_feature (1)..(341): Bit score of 242.8 for HMM based on sequences of FIGURE 2.
  misc_feature (94)..(315): Pfam Name: Abhydrolase_3 Pfam Description: alpha/beta hydrolase fold
  misc_feature (90)..(187): Pfam Name: COesterase Pfam Description: Carboxylesterase
  misc_feature (1)..(341): Functional Homolog Of SEQ ID NO. 99
MADLKAPAKARRLAPPMSWRTRLSIFAAGYLTDATCRADGTINRRLLTYLDPGVPPSAAPRNGVSSRDIDVDAAIPLRARLFHPVGLPGPLPVVLFFHGGGFAYLSAASLAYDAACRRIARYCGAAVLSVDYRRSPEHRFPAAYDDGFSALRFLDDPNKHPADVAPLDVSRCFVAGDSAGANIAHHVARRYAMSSPSFANVRISGLIAIQPFFGGEERTPSELQLEGAPIVSISRCDWMWRAFLPPGADRTHEAAHAASPAAAAGIDSPAFPPAVVVVGGYDPLQDWQRRYCEMLTSKGKEVRVLEYPEAIHAFYVFPEFAESKDLMLRIKEFVAGSDGSK

SEQ ID NO: 1077 - protein, 341 aa, Hordeum vulgare subsp. vulgare
  misc_feature (1)..(341): Public GI ID no. 326532822
  misc_feature (1)..(341): Bit score of 244.2 for HMM based on sequences of FIGURE 2.
  misc_feature (94)..(315): Pfam Name: Abhydrolase_3 Pfam Description: alpha/beta hydrolase fold
  misc_feature (90)..(200): Pfam Name: COesterase Pfam Description: Carboxylesterase
  misc_feature (1)..(341): Functional Homolog Of SEQ ID NO. 99
MADLKAPAKVRRLAPPMSWRSRLSIFAAGYLTDATCRADGTINRRLLTYLDPAVPPSAAPRNGVSSRDIDVDPAIPLRARLFHPVGLAGPLPVVLFFHGGGFAYLSAASLAYDAACRRIARYCGAAVLSVDYRRSPEHRFPAAYDDGFSALRFLDEPKKHPADVGPLDVSRCFLAGDSAGANIAHHVARRYAMSSPSFTKVRVSGLIAIQPFFGGEERTPSELQLEGAPIVSISRCDWMWRAFLPPGADRTHEAAHAASPAAAAGIDSPAFPPAVVVIGGYDPLQDWQRRYCEMLTSKGKEVRVLEYPEAIHAFYVFPEFAESKELMLRIKEFVAGSDGSK

SEQ ID NO: 1078 - DNA, 1356 bp, Panicum virgatum
  misc_feature (1)..(1356): Ceres Clone ID no. 1991076
  misc_feature (1)..(1356): Encodes the peptide sequence at SEQ ID NO. 1079
aggcccagccgcagcgaccgatcgcttcagccccacgccgcggtggccatggcggaggctcccactcccacgacgccggcgcgaaagccgaagccgccgatgtcgcgcctcatgcggctctccctcacggtcgtggaccgcgtcaccgacgccacccgccgcgccgacggcacgctgaaccgcctcgcgctgtccctgctggacccgcgcgtcccggccatctcctccccgtgccgcggcgtcgcgtcccgggacgtcgtcctcgaccgcgccacccgcctccacgcgcgcctcttccacccggcggcagcgaaggccggcgcggcgcggccgctccccgtgatcgtcttcttccacggcggcgggttcgcgttcctctccgcggcgtccccggcctacgacgcggcttgccgccgcatcgcgcggtacgcctccgcggcggtgctctccgtcgactaccgccgcgccccgaagcaccggttcccggcgccctacgacgacggcctcgccgcgctccgcttcctcgacgatcccaagaaccacccgccgctcccgctcccgctggatgtcgcccgctgctacgtcgccggcgacagcgccggcggcaacatcgcgcaccacgtggcccgccgctacgccgccgacgcggcgtccttcaggagcgtccgcctcaggggcctcgtcgccatccagcccttcttcggcggcgaggaacgcaccgactccgagctccggctcgacggcgccgcgcccatcgtgtccatcgaccgcaccgactggatgtggcgcgcgttcctgccgcccggcgccgaccgcacccacgaggccgccaacttcgcgcacccggccgccgcggccgggctcgagtccccggcgttcccgcccgtgctgctcgccgtcggcggcttcgacccgctgcaggactggcagcgccggtacgccgagacgctcacgggcatgggcaaggacgtgcacgtggccgagtacccggacgccatccacgcgttctacctcttccccgtgttcgacgacgcccgggacttgatcatacgcatcgccgagttcgtcgccgagagcgcgccggcggcggcggcgagtgaccaaccgtgacgggtgctcgccgtcgccgtcgttgtcaagtggtgtgtgtcgtggagtgtttggtccgagtgtctggttgcgtcgtggcgtttgcatgggaggatagggccaggtgtggttgcgtgggtgaaagagagtagaaaatgtgtgtgattttgtaataatatatgtttactctggcaagtttggtatacatgatgggtgtgatgagtgatgtaaattaatttatttactaatccagtcggtgatttcgtg

SEQ ID NO: 1079 - protein, 353 aa, Panicum virgatum
  misc_feature (1)..(353): Ceres Clone ID no. 1991076
  misc_feature (1)..(353): Bit score of 245.4 for HMM based on sequences of FIGURE 2.
  misc_feature (93)..(138): Pfam Name: COesterase Pfam Description: Carboxylesterase
  misc_feature (65)..(82): Pfam Name: Abhydrolase_3 Pfam Description: alpha/beta hydrolase fold
  misc_feature (1)..(353): Functional Homolog Of SEQ ID NO. 99
MAEAPTPTTPARKPKPPMSRLMRLSLTVVDRVTDATRRADGTLNRLALSLLDPRVPAISSPCRGVASRDVVLDRATRLHARLFHPAAAKAGAARPLPVIVFFHGGGFAFLSAASPAYDAACRRIARYASAAVLSVDYRRAPKHRFPAPYDDGLAALRFLDDPKNHPPLPLPLDVARCYVAGDSAGGNIAHHVARRYAADAASFRSVRLRGLVAIQPFFGGEERTDSELRLDGAAPIVSIDRTDWMWRAFLPPGADRTHEAANFAHPAAAAGLESPAFPPVLLAVGGFDPLQDWQRRYAETLTGMGKDVHVAEYPDAIHAFYLFPVFDDARDLIIRIAEFVAESAPAAAASDQP

SEQ ID NO: 1080 - protein, 357 aa, Hordeum vulgare subsp. vulgare
  misc_feature (1)..(357): Public GI ID no. 326497909
  misc_feature (1)..(357): Bit score of 238.8 for HMM based on sequences of FIGURE 2.
  misc_feature (105)..(327): Pfam Name: Abhydrolase_3 Pfam Description: alpha/beta hydrolase fold
  misc_feature (89)..(147): Pfam Name: COesterase Pfam Description: Carboxylesterase
  misc_feature (1)..(357): Functional Homolog Of SEQ ID NO. 99
MEATTKNQETGAGDDSARPAPPALPWSVRLQLFALVTTNDIAQRRDGTVNRFLFSFGDRQSPARPRPDAHGVRSADVTVDASRSLWARVYSPAAAAAGQTPLPVLVYFHGGGFTLLSAASTPIDGMCRRFCRELGAVVVSVNYRLAPEHRYPAAYDDCVDVLRYLGDPGLPADVSVPVDLSRCFLGGDSAGGNIVHHVAQRWTGAPPRNSPVRLAGIILLQPYFGGEERTEAEQRLEGVAPVVNMRRSDWAWRAFLPEGADRNHPAAHVTGEAGPEPELAESFPPAMVAVGGLDPLQDWQRRYGAMLRRKGKAVNVLEFPDAIHAFYCFPELPDSGRLVEEMRAFIGTNAPTHHPDA

SEQ ID NO: 1081 - DNA, 1053 bp, Sorghum bicolor
  misc_feature (1)..(1053): Ceres Annot ID no. 8684742
  misc_feature (1)..(1053): Encodes the peptide sequence at SEQ ID NO. 1082
atggcggaggctcccacgacgccgccgcggaagccgaagccgccgatgtcgcgcctcatgcggctctccctcaagttcgtggaccgcttgaccgacgccacccgccgggcagacggcacgctgaaccgctgcgcgctgtcgctgctggacccgcgtgtcccggccatctcctccccttgccgcggcgtcgcctcccgggacgtcgtcctggacggcgcccgccgcctccgcgcgcgcctcttccacccggccactacgacggccaagtccacgtcccccttccccgtgatcgtcttcttccacggcggcgggttcgcgtacctctccgcggcgtccgcggcctacgacgccgcgtgccgccgcatggcgcggtacgcctccgcggccgtgctctccgtcgactaccgccgtgccccggagcaccggttcccggcgccctacgacgacggggtcgcggcgctgcgcttcctcgacgaccccaagaaccacccttccaccaccaccactatcccgctcgacgtctcccgctgcttcgtcgcgggcgacagcgccggcggcaacatcgcgcaccacgtggcccgccgctacgcgtgcgacgccgccacgttcaggaacgtccgcgtcgccggcctgatcgccatccagcccttcttcggcggcgaggagaggacgccctcggagctccgcctggacggcgccgcgcccatcgtgtccatcgaccgcaccgactggatgtggcgcgcgttcctgccaccaggctgcgaccgcacccacgaggccgcaaacttcgcgtccccggccgccgccgcgggcctcgactcgccggcgttcccgcccgtgctgctcgccatcggcggcttcgacccgctgcaggactggcagcgccggtacggcgagatgctcaagagtatgggcaaggacgtgcgggtggctgagtaccccgacgccatccacgccttctacgtcttccccgggttcgacgacgcgcgagacttcatgatacgcgtcgccgagttcgtcgccgaatgcgccggtggcggaagtagcgactag

SEQ ID NO: 1082 - protein, 350 aa, Sorghum bicolor
  misc_feature (1)..(350): Ceres Annot ID no. 8684742
  misc_feature (1)..(350): Bit score of 245.9 for HMM based on sequences of FIGURE 2.
  misc_feature (97)..(321): Pfam Name: Abhydrolase_3 Pfam Description: alpha/beta hydrolase fold
  misc_feature (88)..(136): Pfam Name: COesterase Pfam Description: Carboxylesterase
  misc_feature (1)..(350): Functional Homolog Of SEQ ID NO. 99
MAEAPTTPPRKPKPPMSRLMRLSLKFVDRLTDATRRADGTLNRCALSLLDPRVPAISSPCRGVASRDVVLDGARRLRARLFHPATTTAKSTSPFPVIVFFHGGGFAYLSAASAAYDAACRRMARYASAAVLSVDYRRAPEHRFPAPYDDGVAALRFLDDPKNHPSTTTTIPLDVSRCFVAGDSAGGNIAHHVARRYACDAATFRNVRVAGLIAIQPFFGGEERTPSELRLDGAAPIVSIDRTDWMWRAFLPPGCDRTHEAANFASPAAAAGLDSPAFPPVLLAIGGFDPLQDWQRRYGEMLKSMGKDVRVAEYPDAIHAFYVFPGFDDARDFMIRVAEFVAECAGGGSSD

SEQ ID NO: 1083 - protein, 335 aa, Vitis vinifera
  misc_feature (1)..(335): Public GI ID no. 225463175
  misc_feature (1)..(335): Bit score of 271.0 for HMM based on sequences of FIGURE 2.
  misc_feature (88)..(302): Pfam Name: Abhydrolase_3 Pfam Description: alpha/beta hydrolase fold
  misc_feature (82)..(130): Pfam Name: COesterase Pfam Description: Carboxylesterase
  misc_feature (1)..(335): Functional Homolog Of SEQ ID NO. 99
MTQSSPVLPWKTKFVLSVLSAVTDFARRDDGTINRRLLSFLNFRAPPNSTPVNGVKTSDVTVDPSRNLWFRLFEPTEVPGRGEKLPVIVFFHGGGFAFMSADSKAYDAVCRRFARKIPAIVASVNYRLSPEHRCPAQYDDGFDVLKYLDSQPPANSDLSMCFLVGDSAGANLAHNLTVRACETTTFREVKVVGLVPIQPFFGGEERTESERRLEGSPLVSMRRTDCMWKMFSPEGADRDHEAANVSGPRGRELSEVEFPATMVFIGGFDPLQDWQRRYCEWLKRSGKEVRVLEYGSAIHAFYIFPELPEASLLFAEVKNFVEKQKKTHRQYPSMI

SEQ ID NO: 1084 - protein, 344 aa, Cajanus cajan
  misc_feature (1)..(344): Bit score of 655.0 for HMM based on sequences of FIGURE 2.
  misc_feature (108)..(321): Pfam Name: Abhydrolase_3 Pfam Description: alpha/beta hydrolase fold
  misc_feature (80)..(147): Pfam Name: COesterase Pfam Description: Carboxylesterase
  misc_feature (1)..(344): Functional Homolog Of SEQ ID NO. 99
MAGSNQLNPNDSKVVVPLNMWVLISNFKLSYNLLRRPDGTFNRDLAEFLDRKVPANANPVDGVFSFDVIVDRETNLLTRIYRPAEGEERAVSIVDLEKPVSSEVVPVIIFFHGGSFAHSSANSAIYDTLCRRLVGICKAVVVSVNYRRAPENRYPCAYDDGWTALKWVSSRSWLQSKKDQKVHIYMAGDSSGGNIVHHVALKAVESGIEVFGNILLTPFFGGEERTESEKRLDGRYFVRVKDRDWYWRAFLPEGEDRDHPACNPFGPKGRSLEGVSFPKSLVVVAGLDLVQDWQLGYAKGLEKAGQEVKLLFLEQATIGFYLLPNNEHFSPVMDEIKYFVSSDC

SEQ ID NO: 1085 - protein, 335 aa, Medicago truncatula
  misc_feature (1)..(335): Public GI ID no. 357498903
  misc_feature (1)..(335): Bit score of 243.4 for HMM based on sequences of FIGURE 2.
  misc_feature (92)..(308): Pfam Name: Abhydrolase_3 Pfam Description: alpha/beta hydrolase fold
  misc_feature (84)..(134): Pfam Name: COesterase Pfam Description: Carboxylesterase
  misc_feature (1)..(335): Functional Homolog Of SEQ ID NO. 99
MALETKPRLPWKVRFSTSILSAISDITGRSNGTINRRLLSFIDWKMPPNPNSKSINGVSSSDVVVDPTCNLWFRLFLPSSSTTATTKSLPVIIFFHGGGYAYMSPSSIPYHMLCRLFCRSFPAIVVSVNYGLSPEHRFPSQYEDGLKILKFLDQNVDVLGKYADISKCFLAGDSAGGNLAHHVAARVSLEDFRVLKVIGLVSIQPFFGGEERTESEIRLKRVPICSMDKTDWYWKMFLPDGSNRDHEASNVCGPNAMDISNVDYPNTLVCVGGCDPLVDWQKRYYEWLRKSGKEVQLIEYPNMVHAFFYFPDLPETLDLISKVKDFMIKQMVAMN

SEQ ID NO: 1086 - protein, 362 aa, Oryza sativa Indica Group
  misc_feature (1)..(362): Public GI ID no. 125555059
  misc_feature (1)..(362): Bit score of 239.3 for HMM based on sequences of FIGURE 2.
  misc_feature (101)..(331): Pfam Name: Abhydrolase_3 Pfam Description: alpha/beta hydrolase fold
  misc_feature (78)..(143): Pfam Name: COesterase Pfam Description: Carboxylesterase
  misc_feature (1)..(362): Functional Homolog Of SEQ ID NO. 99
MADAHGHRRRVALPCAVRLRLCLLEAAIDATQRRDGAINRPLFSLYDRRAPADPRPDAAGVSSTDVTVDASRGLWARVFTPPAPEHEHSSSSSTTTPRPVIVYFHGGGFAMFSAASRPFDAHCRTLCAGVGAVVVSVDYRLAPEHRFPAAYDDGEAVLRYLATTGLRDEHGVPMDLSACFLAGDSAGGNIAHHVAQRWTTTTTTPATPPPPSDNPVNLAGVILLEPYFGGEERTKAERALEGVAPVVNIRRSDRWWRAFLPEGADRNHPAAHVTGDAGPEPELQEAFPPAMVVVGGLDPLQDWDRRYAGMLRRKGKAVRVVEFPEAIHAFYFFPEFAGDIRKLVGEIRAFVEDSIMSKQSIA

SEQ ID NO: 1087 - protein, 355 aa, Brachypodium distachyon
  misc_feature (1)..(355): Public GI ID no. 357133715
  misc_feature (1)..(355): Bit score of 672.2 for HMM based on sequences of FIGURE 2.
  misc_feature (118)..(331): Pfam Name: Abhydrolase_3 Pfam Description: alpha/beta hydrolase fold
  misc_feature (111)..(157): Pfam Name: COesterase Pfam Description: Carboxylesterase
  misc_feature (1)..(355): Functional Homolog Of SEQ ID NO. 99
MAGSDEVNRNECKTVVPLTTMVLISNFKVAYNMLRRPDGTFDRDLAEFLDRRVPSNARPVEGVSSFDHVIDQSVGLEVRIYRAAAAADADAGAGAAAVTLPILEFLTGAPSPEPFPVIIFFHGGSFAHSSSSTAIYDHLCRRFVKLSKGVVVSVNYRRAPEHRYPAAYDDGWTALKWALAQPWLRSGESSQLRVFLSGDSSGGNIAHHVAARAADEGIKIYGNILLNAMFGGNERTESERRLDGKYFVTLQDRDWYWKAYLPEDADRDHPACNPFGPNGRRLRGLPFTKSLIIVSGLDLTCDRQLAYAENLREDGLDVKVVHREKATIGFYLLSNTDHYHEVMEEISDFLQANLL

SEQ ID NO: 1088 - DNA, 1220 bp, Triticum aestivum
  misc_feature (1)..(1220): Ceres Clone ID no. 892953
  misc_feature (1)..(1220): Encodes the peptide sequence at SEQ ID NO. 1089
gctaggggaagcgctaggctccttcagttcagtctactacacaatttaacacgggaggaggtgagacatggaggccacgacgaagaaccaagaaacgggcgccggcgacgagaccgcgcggcccgccccgccggtgctgccgtggtcggtgaggctccagctgttcgcgctcgtcaccgccaacgacatcgcgcagcgccgcgacgggaccgtcaaccgcttcctcttctccttcggcgaccggcagtcgcccgcgaggccgcgcccggacgcgcacggcgtccgctccgccgacgtcaccgtcgacgcctcccggaacctctgggcgcgcgtctactcccccgcggcggaggcggccgggccggccccgctccccgtcctcgtctacttccacggcggcggcttcacgctgctctccgcggcctccacgcccatcgacggcatgtgccgccgcttctgccgcgagctaggcgccgtggtcttctccgtgaactaccgcctcgcgcccgagcaccgccacccggccgcctacgacgactgcgtggacgtgctccgctaccttggcgccaccgtcctccccgcggacgtctccgtcccggtcgacctctcccgctgcttcctcggcggggacagcgcggggggcaacatcgtccaccacgtcgcccagcggtggacggaagcgcctccctccgacagccccgtccgccttgccggcatcatcctcctgcagccgtacttcggcggcgaggagcgcacggaggcggagctgaggctggagggcgtggcgccggtggtgaacatgcggcgctccgactgggcgtggagggcgttcctgccggagggggcggaccggaaccacccggcggcgcacgtgacgggcgaggcgggcccggagcccgagctggcggaggcgttcccgccggcgatggtggccgtcggcgggctggatccgctgcaggactggcagcagcggtacggcgccatgctgcggcggaaggggaaggcggtcaaggtgctcgagttcccggacgccatccacgccttctactgcttccccgagctccccgactcaggcaggctcgtggaggagatcagggcgttcatcgggaccaaaacggccactcatcaccccgatgcttaagaagatctgcgtgatgcgaagggtataatttgaacttaattcctgtgtgatacctatagcgatcaattgcgttttagat

SEQ ID NO: 1089 - protein, 357 aa, Triticum aestivum
  misc_feature (1)..(357): Ceres Clone ID no. 892953
  misc_feature (1)..(357): Bit score of 236.6 for HMM based on sequences of FIGURE 2.
  misc_feature (105)..(327): Pfam Name: Abhydrolase_3 Pfam Description: alpha/beta hydrolase fold
  misc_feature (89)..(147): Pfam Name: COesterase Pfam Description: Carboxylesterase
  misc_feature (1)..(357): Functional Homolog Of SEQ ID NO. 99
MEATTKNQETGAGDETARPAPPVLPWSVRLQLFALVTANDIAQRRDGTVNRFLFSFGDRQSPARPRPDAHGVRSADVTVDASRNLWARVYSPAAEAAGPAPLPVLVYFHGGGFTLLSAASTPIDGMCRRFCRELGAVVFSVNYRLAPEHRHPAAYDDCVDVLRYLGATVLPADVSVPVDLSRCFLGGDSAGGNIVHHVAQRWTEAPPSDSPVRLAGIILLQPYFGGEERTEAELRLEGVAPVVNMRRSDWAWRAFLPEGADRNHPAAHVTGEAGPEPELAEAFPPAMVAVGGLDPLQDWQQRYGAMLRRKGKAVKVLEFPDAIHAFYCFPELPDSGRLVEEIRAFIGTKTATHHPDA

SEQ ID NO: 1090 - DNA, 1367 bp, Zea mays
  misc_feature (1)..(1367): Ceres Clone ID no. 330490
  misc_feature (1)..(1367): Encodes the peptide sequence at SEQ ID NO. 1091
attaacaaagctgcagcttcgaggcctcacctcccgagccgaaagcgattcatagcatcatctattcatccgcgcgtggtgcaatggaggaggctcccacgacgccgccgcggaaggcgaagccgctgatgtcgcgcctcatgcggctttccatcaaggtcgtggacagggtcaccgacgccacccgccgggcagacgggacgctgaatcgttttgcgctctcgctgctggacccgcgtgtcccggccatctcctccccttgccgtggcgtcgcctcccgggacgtcatcctcgacggcgccctccgcctccgcgcgcgcctattccacccggccacgacgtcaaaatccacggcccctctccccgtgatcgtctttttccacggcggcgggttcgcgtacctctccgcggcgtccccggcctacgacgccgcgtgccgccgcatcgcgcggtacgcctccgcggcagtgctctcggtcgactaccgccgcgctcccgagcaccggttcccggcgccctacgatgacggtatcgcggcgctgcgcttcctcgacgatccaaagaaccaccccaccccgctcgacgtgtcccgcagcttcgtcgcgggcgacagcgctggcggcaacatcgcccaccacgtggcccgccgctacgcgtccgacgtcgcctcgttcaggaacatccgtgtcgccggcctgatcgccatccagcccttcttcggcggcgaggagcggacaccctccgagctccgcctagacggcgccgcgcccatcgtgtccatcgaccgcaccgactggatgtggcgcgcgttcctgccgcccggctgcgaccgtacccacgagggtgccaacttcgcatccccagcagccgccgccggcctcgactcccaggcgttccctcccgtcctgctcgtcatcggtggcttcgacccgctgcaggattggcagcgccggtacggcgagatgctgaagagcatgggcaaggatgtgcgagtggttgagtaccctgacgccatccacgccttctacgtcttccccgggttcgacaacgcgcgagatttcatgatacgcatcgccaagttcgtcgccgaaagcgccagcggcagaagtagcagctagcgagttgtcggagctggagatacagtctgcacactgtgcagtggtcaggtgtttggtgcaagtggcgtgtcgtgcgtcgcaatttgcagccttggctgtggcgttttggaggatgcggcggtatggttgcgtggttgagtgagagaagaagatgtgtctggttgttattgttaactttcgtaaaagtttggtctgataagtctgatgaatgatgtaattttaattaactaatcaagttggtgatttcgt

SEQ ID NO: 1091 - protein, 344 aa, Zea mays
  misc_feature (1)..(344): Ceres Clone ID no. 330490
  misc_feature (1)..(344): Bit score of 245.6 for HMM based on sequences of FIGURE 2.
  misc_feature (96)..(315): Pfam Name: Abhydrolase_3 Pfam Description: alpha/beta hydrolase fold
  misc_feature (83)..(135): Pfam Name: COesterase Pfam Description: Carboxylesterase
  misc_feature (1)..(344): Functional Homolog Of SEQ ID NO. 99
MEEAPTTPPRKAKPLMSRLMRLSIKVVDRVTDATRRADGTLNRFALSLLDPRVPAISSPCRGVASRDVILDGALRLRARLFHPATTSKSTAPLPVIVFFHGGGFAYLSAASPAYDAACRRIARYASAAVLSVDYRRAPEHRFPAPYDDGIAALRFLDDPKNHPTPLDVSRSFVAGDSAGGNIAHHVARRYASDVASFRNIRVAGLIAIQPFFGGEERTPSELRLDGAAPIVSIDRTDWMWRAFLPPGCDRTHEGANFASPAAAAGLDSQAFPPVLLVIGGFDPLQDWQRRYGEMLKSMGKDVRVVEYPDAIHAFYVFPGFDNARDFMIRIAKFVAESASGRSSS

SEQ ID NO: 1092 - protein, 236 aa, Allium cepa
  misc_feature (1)..(236): Public GI ID no. 169159266
  misc_feature (1)..(236): Bit score of 307.8 for HMM based on sequences of FIGURE 2.
  misc_feature (92)..(202): Pfam Name: Abhydrolase_3 Pfam Description: alpha/beta hydrolase fold
  misc_feature (86)..(132): Pfam Name: COesterase Pfam Description: Carboxylesterase
  misc_feature (1)..(236): Functional Homolog Of SEQ ID NO. 99
MLVPLNTHVLISQFKVAYRMLRRSDGTFNRHLAEFLDRKVPANATPINNVLSFDLLLDRSTNLLVRIYRHAPHPVSYQSLFLPPSPSPFPLIIFFHGGSFAHSSSNSAIYDSLCRRLVSLVGPSIVISVNYRRTPEYRYPSAYDDGWAVLNWASNESWLSNGSIFLCGDSSGGNIAHNVALRAVDSKLVIHGNILLNPMFGGNRRTEIGKEVRWKILCNYPRQGLVLEGLFARWSR

SEQ ID NO: 1093 - protein, 338 aa, Ricinus communis
  misc_feature (1)..(338): Public GI ID no. 255564994
  misc_feature (1)..(338): Bit score of 261.1 for HMM based on sequences of FIGURE 2.
  misc_feature (91)..(309): Pfam Name: Abhydrolase_3 Pfam Description: alpha/beta hydrolase fold
  misc_feature (77)..(133): Pfam Name: COesterase Pfam Description: Carboxylesterase
  misc_feature (1)..(338): Functional Homolog Of SEQ ID NO. 99
MAERNQQWPDNIPWNVKLFIHALSFGLDITRRSDGIVNRCLMSFFDIKASPSKKPIKGVMSADITVDKARNLWFRLYTPTTITTDDGLPVIFFFHGGGFAYMSANSKPYNDFCYQLARELSAIIISVSYRLAPEHRCPTQYEDCFDTMRFIDSTGIEQISSIANLKQCFIAGDSAGGNLVHHVAVKASEYEFSNIKLIGNIVIQSFFGGEERTESELRLTRAPFVTMERADWMWKVFLPEGSNRDHWAANVFGPNSLVDISGVKFPATIVFVGGFDPLQDWQKRYYEALKKFGKEAYLVEYPNAFHTFYAYPEVAEASLFLKEVKNFMQKQSAIATNI

SEQ ID NO: 1094 - protein, 253 aa, Cajanus cajan
  misc_feature (1)..(253): Bit score of 493.4 for HMM based on sequences of FIGURE 2.
  misc_feature (17)..(230): Pfam Name: Abhydrolase_3 Pfam Description: alpha/beta hydrolase fold
  misc_feature (13)..(109): Pfam Name: COesterase Pfam Description: Carboxylesterase
  misc_feature (1)..(253): Functional Homolog Of SEQ ID NO. 99
MKDLERPLSTTEIVPVIIFFHGGSFSHSSANSAIYDTFCRRLVSICKAAVVSVNYRRSPEHRYPCAYDDGWAALKWVKSRTWLQSGSESKVHVYLAGDSSGGNIVHHVAAMAAEEEIEVLGNILLHPLFGGEKRTESELRLDGKYFVRLQDRDWYWRAFLPEGEDRDHPACNPFGPRGKSIRGLSFPKSLVCVAGLDLLQDWQLAYAKGLEDSGHQVKLLYLKDATIGFYFLPNNDHFYCLMKEINNFVNSNY

SEQ ID NO: 1095 - protein, 335 aa, Arabidopsis thaliana
  misc_feature (1)..(335): Public GI ID no. 15237783
  misc_feature (1)..(335): Bit score of 235.2 for HMM based on sequences of FIGURE 2.
  misc_feature (90)..(307): Pfam Name: Abhydrolase_3 Pfam Description: alpha/beta hydrolase fold
  misc_feature (78)..(132): Pfam Name: COesterase Pfam Description: Carboxylesterase
  misc_feature (1)..(335): Functional Homolog Of SEQ ID NO. 99
MATDSQPNQKLTLPLKTRIALTVISTMTDNAQRPDGTINRRFLRLFDFRAPPNPKPVNIVSTSDFVVDQSRDLWFRLYTPHVSGDKIPVVVFFHGGGFAFLSPNAYPYDNVCRRFARKLPAYVISVNYRLAPEHRYPAQYDDGFDALKYIEENHGSILPANADLSRCFFAGDSAGGNIAHNVAIRICREPRSSFTAVKLIGLISIQPFFGGEERTEAEKQLVGAPLVSPDRTDWCWKAMGLNRDHEAVNVGGPNAVDISGLDYPETMVVVAGFDPLKDWQRSYYEWLKLCGKKATLIEYPNMFHAFYIFPELPEAGQLIMRIKDFVDERVASLSA

SEQ ID NO: 1096 - protein, 339 aa, Picea sitchensis
  misc_feature (1)..(339): Public GI ID no. 116781798
  misc_feature (1)..(339): Bit score of 272.2 for HMM based on sequences of FIGURE 2.
  misc_feature (98)..(314): Pfam Name: Abhydrolase_3 Pfam Description: alpha/beta hydrolase fold
  misc_feature (85)..(189): Pfam Name: COesterase Pfam Description: Carboxylesterase
  misc_feature (1)..(339): Functional Homolog Of SEQ ID NO. 99
MEMAAENADHGSMVSGSKSVPLRIRVLCWLVKNAGAVTRRNDGTVNRRLANLIDRKVSADQTPRHGVYTKDIVIDKTTGVRVRLFVPDNGAHGDFPVVVYFHGGAFCALSGADVAYDTFCRKLAGRLTVAVVSVDYRLAPEHKCPAAYDDCFVALAWLRAQGRDCLPPSADLSRCFLMGDSAGGNIVHHVGCRVAREADMSPIKIAGHVLMQPYFGGEERTPAEVRLSNGVPLITVEAADWYWRAFLPEGATRDHPAANVTSTDISELSLPPSLVVVGGLDLLQDWQLRYAEHLKKMGKQAEILFYEDAIHAFHVFPGYDLTPRFLRDLAHFLQVRADL

SEQ ID NO: 1097 - protein, 346 aa, Malus x domestica
  misc_feature (1)..(346): Public GI ID no. 380040722
  misc_feature (1)..(346): Bit score of 670.0 for HMM based on sequences of FIGURE 2.
  misc_feature (108)..(323): Pfam Name: Abhydrolase_3 Pfam Description: alpha/beta hydrolase fold
  misc_feature (102)..(148): Pfam Name: COesterase Pfam Description: Carboxylesterase
  misc_feature (1)..(346): Functional Homolog Of SEQ ID NO. 99
MAGSNEVNVNESKKVVPLNTWVLISNFKLAYNLLRRADGTFNRELAEFLDRKVPANTVPVDGVFSFDHVDRATGLLNRVYQFAPQNESQWGIVDLEQPLSTTKVVPVIIFFHGGSFTHSSANSAIYDTFCRRLVNTCKAVVVSVNYRRSPEHRYPCAYEDGWAALKWVKSRKWLQSGKGKDLKVHVYLAGDSSGGNIAHHVAVKAAEAEVEVLGNILLHPMFAGQKRTESEKRLDGKYFVTIQDRDWYWRAFLPEGEDRDHPACHVFGPRDKSLEGLKFPKSLVVVAGFDLMQDWQLAYVEGLKNAGQDVKLLFLKQATIGFYFLPNNEHFYCLMEEMKTFVNPDC

SEQ ID NO: 1098 - DNA, 1008 bp, Populus balsamifera subsp. trichocarpa
  misc_feature (1)..(1008): Ceres Annot ID no. 1442123
  misc_feature (1)..(1008): Encodes the peptide sequence at SEQ ID NO. 1099
atgtctcaaaactcagctgacctcccatggaaggtaaggctctttacatccctcatctccttcacctttaaagtcatgattcgtcgctctgatggatctctgaaccgcctcttgctcaactttctcgactataaaacctctccatcgcctgacaagcccatagatggtgtcacaaccactgatttcactattgatgaagaccgcaacctttggttccgcctctacaaccccgtcttcagaacttcaaccaccgacaatgaagttaacatcccagttattttctacttccacgggagtgggttcgtctgcatggcggccaattcaaagctgtttgatgatttatgctacaggctcgcccgcctgctacctgcagtcatcatctctgtaaactacaggctggctcctgagcataggtatccatgccaatatgaagacggttttgatgttataaaatttattgatatatcataccttgaagtccttccaaaccatgccaatctcaagcacagttttgttgctggagacagtgctggtggcaatctagctcatcacatggcactaaaggctagcaaatatgaactttccaacataaaactgaatggagttatagccatacagccattctttggaggagaagagcgtacaggatctgaaatcaagctttccagagatcccattgttccaatggatactacagactggatgtggagatcgtttctgccagagggttcgaatcgggaccatcaggtgtcgaatgtttttgggcctaactctgttgacatttcagagcttgaattccctgcagttcttgttattattggggggttggatcctctccaggactggcaaaagaggtactgcgagggactgaagaaaagtggaaaagaagtgtatttagtggagtatgacaacgcattccattcattttacctttttccttgtgtgcctgagttttctttgtttatcaaggaagtgaaagattttatgcaaaagcaaatgtccagatga

SEQ ID NO: 1099 - protein, 335 aa, Populus balsamifera subsp. trichocarpa
  misc_feature (1)..(335): Ceres Annot ID no. 1442123
  misc_feature (1)..(335): Bit score of 271.9 for HMM based on sequences of FIGURE 2.
  misc_feature (93)..(310): Pfam Name: Abhydrolase_3 Pfam Description: alpha/beta hydrolase fold
  misc_feature (78)..(135): Pfam Name: COesterase Pfam Description: Carboxylesterase
  misc_feature (1)..(335): Functional Homolog Of SEQ ID NO. 99
MSQNSADLPWKVRLFTSLISFTFKVMIRRSDGSLNRLLLNFLDYKTSPSPDKPIDGVTTTDFTIDEDRNLWFRLYNPVFRTSTTDNEVNIPVIFYFHGSGFVCMAANSKLFDDLCYRLARLLPAVIISVNYRLAPEHRYPCQYEDGFDVIKFIDISYLEVLPNHANLKHSFVAGDSAGGNLAHHMALKASKYELSNIKLNGVIAIQPFFGGEERTGSEIKLSRDPIVPMDTTDWMWRSFLPEGSNRDHQVSNVFGPNSVDISELEFPAVLVIIGGLDPLQDWQKRYCEGLKKSGKEVYLVEYDNAFHSFYLFPCVPEFSLFIKEVKDFMQKQMSR

SEQ ID NO: 1100 - protein, 368 aa, Glycine max
  misc_feature (1)..(368): Public GI ID no. 356504896
  misc_feature (1)..(368): Bit score of 643.7 for HMM based on sequences of FIGURE 2.
  misc_feature (108)..(321): Pfam Name: Abhydrolase_3 Pfam Description: alpha/beta hydrolase fold
  misc_feature (104)..(201): Pfam Name: COesterase Pfam Description: Carboxylesterase
  misc_feature (1)..(368): Functional Homolog Of SEQ ID NO. 99
MAGSNQVNLNESRSVVPLNTWVLISNFKLSYKLLRRDDGTFNRELAEYLDRKVPANAIPVEGVFSIDHVDRNAGLFYRVYLPTSGNEAQWGIRDLEKPLSTTEIVPVIVFFHGGSFSHSSANSHIYDTFCRRLVRICKAAVVSVNYRRSPEHRYPCAYDDGWAALRWVKSRAWLQSGREAKVHVYLAGDSSGGNIVHHVAVRAAEEEIEVLGNILLHPLFGGEKRTESELRLDGKYFVRLKDRDWYWRAFLPEGENRDHPACNPFGPRGRSIEGLKFPKSLVCVAGLDLLQDWQLAYAKGLEDCGQQVKLLFLKEATIGFYFLPNNDHFYCLMKEINNFVNSDSDYDYYYYCYYLTLPYLQEAYITKA

SEQ ID NO: 1101 - protein, 331 aa, Glycine max
  misc_feature (1)..(331): Public GI ID no. 356559969
  misc_feature (1)..(331): Bit score of 249.5 for HMM based on sequences of FIGURE 2.
  misc_feature (89)..(304): Pfam Name: Abhydrolase_3 Pfam Description: alpha/beta hydrolase fold
  misc_feature (75)..(130): Pfam Name: COesterase Pfam Description: Carboxylesterase
  misc_feature (1)..(331): Functional Homolog Of SEQ ID NO. 99
MASELTKLILPWKVRLLISLLSTLADTSRRSNATINRRLFNLADRQSLPNPTPVDGVSSSDVTVDPARNLWFRLFVPSSSSATTLPVFVYFHGGAFAFFSAASTPYDAVCRLYCRSLNAVVISVNYRLAPEHRYPSQYDDGFDVLKFIDRNGSVLPDVADVTKCFLAGDSAGANLAHHVAVRVSKEKLQRTNIIGLVSVQPYFGGEERTKSEIQLNRAPIISVDRTDWHWKVFLPNGSDRDHEAVNVSGPNAVDISGLDYPNTIVFMGGFDPLRDWQRKYYEWLRESGKEVELVDYPNTFHAFYFFSELPETSLFVYDVKEFMAKQMANVN

SEQ ID NO: 1102 - protein, 345 aa, Solanum lycopersicum
  misc_feature (1)..(345): Bit score of 673.6 for HMM based on sequences of FIGURE 2.
  misc_feature (108)..(321): Pfam Name: Abhydrolase_3 Pfam Description: alpha/beta hydrolase fold
  misc_feature (79)..(148): Pfam Name: COesterase Pfam Description: Carboxylesterase
  misc_feature (1)..(345): Functional Homolog Of SEQ ID NO. 99
MVDTKEINTNESKRVVPLNTWILISNFKLAYNMLRRSDGTFNRDLAEFLERKVPANSIPVDGVYSFDVVDRSTSLLNRVYKPAPKNESDWGKIDLDKPLSTTEIVPVIIFFHGGSFTHSSANSAIYDTFCRRLVSICKAVVVSVNYRRSPENRYPCAYDDGWAALKWVKSRQWLQSGKDLKVHVYMAGDSSGGNIAHHVAVQAAESGVEVFGNILLHPMFGGQKRTESESRLDGKYFVTVQDRDWYWRAYLPEGEDRDHPACNIFGPRGRTLEGLNFPKSLVVVAGLDLVQDWQLTYVEGLQKSGHEVNLLYLKQATIGFYFLPNNDHFRCLMEEITSFIHPNHS

SEQ ID NO: 1103 - DNA, 1050 bp, Sorghum bicolor
  misc_feature (1)..(1050): Ceres Annot ID no. 8657010
  misc_feature (1)..(1050): Encodes the peptide sequence at SEQ ID NO. 1104
atgggaggctgcgacgaccacgcccgccggccgccgtccctgccgtggacggtgcgcgtccagctggccgcgctcgcgttggcacaccgccgggacggcagcgtccggcgcctcctcttctccctcggcgacctcaagtctggcaccacgtcccgcccgggcgcctcggggtcgggggtgcgctccgcggacgtcaccatcgacgcctcccgcggcctgtgggcgcgcgtcttctccccctcgcccgccgcggacgcggacgcggacgccgagccggcccccgttcccatcgtcgtctacttccacggcggagggttcgtgctcttctccgcggcgtcccgcccctacgacgccttctgccgccggctctgccgcgacctccacgccgtcgtcgtgtccgtcaactaccgcctggcacccgagcaccggttccccgcggcgtacgacgacggcgttgcggcgctccgctacctcgacgccaacgccgactccctgccggaggcccacgtccccgtcgacctctccagctgcttcctcgcgggcgacagcgcgggcggcaacatcacgcaccacgtggcgcagcgctgggcggcgtcgtcgcccgccgcgaacctccacgtcgccggcgccgtcctgatccagccgttcttcggtggggaggagcggacggaggctgaggtggcgctggaccgggtgtccgcgctgtcggtggcggcgacggaccactactggagggagttcctgccggagggcgccacgcgggaccacgaggcggcgcgcgtgtgcggcgagggcgtcgagctcgccgacgcgttcccgcccgcgatggtggtggtcggcggcttcgacctgctcaaggactggcaggccaggtacgtggaggcgctgcgcgggaaggggaagccggtgcgggtggtcgagtaccccgacgctgtccacggcttccacgcgttcccggagctcgccgactccggcaagttcgtggaggagatgaagctgttcgtccaagagcatagctccaccaaacaccaagcgtgcctcggaatttga

SEQ ID NO: 1104 - protein, 349 aa, Sorghum bicolor
  misc_feature (1)..(349): Ceres Annot ID no. 8657010
  misc_feature (1)..(349): Bit score of 235.2 for HMM based on sequences of FIGURE 2.
  misc_feature (98)..(316): Pfam Name: Abhydrolase_3 Pfam Description: alpha/beta hydrolase fold
  misc_feature (87)..(140): Pfam Name: COesterase Pfam Description: Carboxylesterase
  misc_feature (1)..(349): Functional Homolog Of SEQ ID NO. 99
MGGCDDHARRPPSLPWTVRVQLAALALAHRRDGSVRRLLFSLGDLKSGTTSRPGASGSGVRSADVTIDASRGLWARVFSPSPAADADADAEPAPVPIVVYFHGGGFVLFSAASRPYDAFCRRLCRDLHAVVVSVNYRLAPEHRFPAAYDDGVAALRYLDANADSLPEAHVPVDLSSCFLAGDSAGGNITHHVAQRWAASSPAANLHVAGAVLIQPFFGGEERTEAEVALDRVSALSVAATDHYWREFLPEGATRDHEAARVCGEGVELADAFPPAMVVVGGFDLLKDWQARYVEALRGKGKPVRVVEYPDAVHGFHAFPELADSGKFVEEMKLFVQEHSSTKHQACLGI

SEQ ID NO: 1105 - protein, 354 aa, Brachypodium distachyon
  misc_feature (1)..(354): Public GI ID no. 357152486
  misc_feature (1)..(354): Bit score of 245.9 for HMM based on sequences of FIGURE 2.
  misc_feature (105)..(326): Pfam Name: Abhydrolase_3 Pfam Description: alpha/beta hydrolase fold
  misc_feature (100)..(125): Pfam Name: COesterase Pfam Description: Carboxylesterase
  misc_feature (1)..(354): Functional Homolog Of SEQ ID NO. 99
MADAGAAPAAAKARRLAPPMSWRARLSILAAGYLTDATRRADGTINRRLLTFLDPGVPASAAPRNGVASRDIDLHAGHGPLPLRARLFFPAGAHASPGPRPLPVVVFFHGGGFAYLSAASPAYDAACRRIARHCAAAVLSVDYRRSPEHKFPAPYDDGFSALRFLDNPKNHPADIPQLDVSRCFLAGDSAGANIAHHVARRYAMALSSFSHLRILGLISIQPFFGGEERTASELELDGAPIVSVSRCDWMWRAFLPPGADRTHEACAAAGAAAAAGVESAAFPPAVVVVGGYDPLQDWQRRYCEALRAMGKEVRVLEYPEAIHAFYVFPEFAESRDLMLRIKEIVAGSGGGGRK

SEQ ID NO: 1106 - protein, 340 aa, Medicago truncatula
  misc_feature (1)..(340): Public GI ID no. 357498895
  misc_feature (1)..(340): Bit score of 274.1 for HMM based on sequences of FIGURE 2.
  misc_feature (98)..(314): Pfam Name: Abhydrolase_3 Pfam Description: alpha/beta hydrolase fold
  misc_feature (91)..(139): Pfam Name: COesterase Pfam Description: Carboxylesterase
  misc_feature (1)..(340): Functional Homolog Of SEQ ID NO. 99
MSKNQPKPLLPWKVRATISLLTVLTDASCRANGTVNRRLFNFFDLKSSPNATPVNGVSTKDVTVNAENNVWFRLFTPTVAGEVTGDGGATKATSLPVVIFFHGGGYTFLSPSSNLYDAVCRRLCREISAVIVSVNYRLTPEHRYPSQYEDGEAVLRFLDENVTVLPANADLSKCFLAGDSAGGNLAHDVVVRACKTGLQNIRVIGLILIQPFFGGEERTEAEINLVGMPFVSVAKTDWIWKVFLPEGSDRDHGAVNVCGPNAEDLSGLDYPDTLVFVGGFDPLIDWQKRYYDWLKKCGKKAELIEYPNMVHGFHVFPDFPESTQLIMQVKDFINKVSNSK

SEQ ID NO: 1107 - DNA, 1158 bp, Panicum virgatum
  misc_feature (1)..(1158): Ceres Clone ID no. 1996207
  misc_feature (1)..(1158): Encodes the peptide sequence at SEQ ID NO. 1108
agtaggcaggaaatgggcggccctcacagcggccgccggtcgccggccctgccgtggacggtgcgcgccaagctggccgctctcgcggctgtgcaacgccgggacggcagcttccggcggcgcctcttctcgctgctcgaccggccagccaccgccaatccccgcccggacgcctcgggcgtgtcctccgccgacgtcaccatcgacgcctcccgcggcctctgggcgcgcgtcttcgccccctcggcgccggcgccggcggcacacgacgccccgctccccgtcgtcgtctacttccacggcggcgggttcgtggcgctctccgcggcgtcgcgcccctacgacgccctctgccgggagatctgccgcgcgctcggcgccgtcgtcgtgtccgtggactaccgcctcgcccctcgccaccgcttccccgccgcctacgacgacggcgtcgccgcgctgcgctacctcggcgccagcagcgccctgccgggcgtccccgccgccatcgacctctccagctgcttcctcgccggcgacagcgcgggcggcaacatcgcccaccacgtggcccagcgctgggcggcggcgccgacgccgccgacgtcttcgccaaccgtaagcctccgcgtcgccggcgtcatcctggtacagccgttcttcggcggggaggagcggacgggggcggaggtggcgctcgacaaggcgtgccgctctctgtcggtggccgcggcggattactattggagggagttcttgccggagggcgccacccgggaccacgcggcggcgcacgtgtgcggcgaggacgccgaggtggccgagtcgttcccgccggcgatggtggtgatcggcgggttcgacctgctcaaggactggcaggcgaggtacgtggaggcgctgcgcgggaaggggaagccggtgaaggtggtcgagtatccggacgccatccacggcttccacgcgttcccggagatcgccgacaccggcaagcttgtggaggagatgaagctgttcgtcgaagaacacaggtctgagcgtgtcccctagattgtccacctttgtacttctaggtttccattgagttcatgtaagattatgcaagatcaggtatgctttacttgcgaaaagagtgcttgccaagaggcgcagattttactt

SEQ ID NO: 1108 - protein, 344 aa, Panicum virgatum
  misc_feature (1)..(344): Ceres Clone ID no. 1996207
  misc_feature (1)..(344): Bit score of 234.9 for HMM based on sequences of FIGURE 2.
  misc_feature (79)..(134): Pfam Name: COesterase Pfam Description: Carboxylesterase
  misc_feature (76)..(86): Pfam Name: Abhydrolase_3 Pfam Description: alpha/beta hydrolase fold
  misc_feature (1)..(344): Functional Homolog Of SEQ ID NO. 99
MGGPHSGRRSPALPWTVRAKLAALAAVQRRDGSFRRRLFSLLDRPATANPRPDASGVSSADVTIDASRGLWARVFAPSAPAPAAHDAPLPVVVYFHGGGFVALSAASRPYDALCREICRALGAVVVSVDYRLAPRHRFPAAYDDGVAALRYLGASSALPGVPAAIDLSSCFLAGDSAGGNIAHHVAQRWAAAPTPPTSSPTVSLRVAGVILVQPFFGGEERTGAEVALDKACRSLSVAAADYYWREFLPEGATRDHAAAHVCGEDAEVAESFPPAMVVIGGFDLLKDWQARYVEALRGKGKPVKVVEYPDAIHGFHAFPEIADTGKLVEEMKLFVEEHRSERVP

SEQ ID NO: 1109 - DNA, 1239 bp, Zea mays
  misc_feature (1)..(1239): Ceres Clone ID no. 335133
  misc_feature (1)..(1239): Encodes the peptide sequence at SEQ ID NO. 1110
gtgacattgttgtgcgccttccactacagtaatggaagcaggcgccggggaagcagcaccaagcgcgccgcgcagactgaccctgccgtggaaggtgcggctcctgctcctctgcctcgatgtcgtcgccggtctctcgatgcgtcgcgacggcaccatcaaccgctccatcttcaacctcttcgaccttcgtgccaccgccagcacgcgcccggacaggcagggcgtccggtccgccgacgtggacgcgtcgcgcggcctgtgggcgcgcgtgttctggccgtcgccggagtcgtccgcggccccgctcccagtcgtggtatacttccacggcggcgccttcacgctgctctctgcggcctcgtacgtctacgacgccatgtgccgccggttctgccgcgagctgggcgccgtcgtcgtgtccgtcaactaccgcctcgcacccgagcaccgctggcccgccgcgtacgaggacggcgtcgccatgcttcgatacctcgcctccgcgggtctccccgacagcgtcgacgtccccgtggacctctcccgctgcttcctcgccggggacagcgccggcgccaacatcgcccaccacgtggcgcagcgctggacgacggcctcctccccgccgcggtccatccccgtccacctcgctggcgccatcctggtgcagccgtactttggcggcgaggagcggacggaagctgaggtcaggctggatgggaacgtgccggtggtgaccgtgcgtggctcggactggatgtggcgggcgttcctgccggaaggcgccgatcggaaccactccgccgcgcacgtgacagacgacaacgccgacctggcggacggctttccgccggtgatggtggtgatcggtggcttcgacccgctgcaggagtggcagaggcggtacgccgacgtgctgcggaggagggggaaggaggtaagggtggtggagttcccggacgccattcacactttcttcctcttccccgagctcaccgatcatggtacgctcgtggaggcgatgaaggcgttcatacgcgagcaacgcatctgatctaattctgcctcacggtcacggatcaccaacctacgtggacctacatggtccgtgcaaataattttgtttcccatgcacgtaatggtccctacatggtccgtgcaaataatttctctataaaccactattcaagtctcccatatatttattcagttcatcgagcatctcttctagatctt

SEQ ID NO: 1110 - protein, 341 aa, Zea mays
  misc_feature (1)..(341): Ceres Clone ID no. 335133
  misc_feature (1)..(341): Bit score of 235.4 for HMM based on sequences of FIGURE 2.
  misc_feature (96)..(317): Pfam Name: Abhydrolase_3 Pfam Description: alpha/beta hydrolase fold
  misc_feature (81)..(138): Pfam Name: COesterase Pfam Description: Carboxylesterase
  misc_feature (1)..(341): Functional Homolog Of SEQ ID NO. 99
MEAGAGEAAPSAPRRLTLPWKVRLLLLCLDVVAGLSMRRDGTINRSIFNLFDLRATASTRPDRQGVRSADVDASRGLWARVFWPSPESSAAPLPVVVYFHGGAFTLLSAASYVYDAMCRRFCRELGAVVVSVNYRLAPEHRWPAAYEDGVAMLRYLASAGLPDSVDVPVDLSRCFLAGDSAGANIAHHVAQRWTTASSPPRSIPVHLAGAILVQPYFGGEERTEAEVRLDGNVPVVTVRGSDWMWRAFLPEGADRNHSAAHVTDDNADLADGFPPVMVVIGGFDPLQEWQRRYADVLRRRGKEVRVVEFPDAIHTFFLFPELTDHGTLVEAMKAFIREQRI

SEQ ID NO: 1111 - protein, 345 aa, Brachypodium distachyon
  misc_feature (1)..(345): Public GI ID no. 357116047
  misc_feature (1)..(345): Bit score of 226.7 for HMM based on sequences of FIGURE 2.
  misc_feature (100)..(321): Pfam Name: Abhydrolase_3 Pfam Description: alpha/beta hydrolase fold
  misc_feature (88)..(142): Pfam Name: COesterase Pfam Description: Carboxylesterase
  misc_feature (1)..(345): Functional Homolog Of SEQ ID NO. 99
MADGTREQLRARVRAALPWKVRLQLFRLEAAFDVTQRRRDGTVNRCLFNLIADRRQVPADDASGGVRSVDVMVNASTGVTVRVFFAAPEPTAPSPLRPVVVYFHGGGFTVFSAATGPLDALCRTICRDAGAVVVSVSYRLAPEHRYPAAYDDGEAVLRYLAANAAGLPVPIDLSRCFLAGDSAGGNIVHHVAHRWTASPPPTDTSIRLAGVMLIAAFFGGEERTDSELALEGVAPIMNLRRSDFWWKAFLPVGADRNHPTAHVTGEAGPEPELAEAFPPAMVVVGGLDPLQDWERRYAAMLRRKGKAVRVVEFPEAVHGFYFFLALPESGKLIAEISAFVQSVTP

SEQ ID NO: 1112 - DNA, 1193 bp, Glycine max
  misc_feature (1)..(1193): Ceres Clone ID no. 625081
  misc_feature (1)..(1193): Encodes the peptide sequence at SEQ ID NO. 1113
actttcattctccgagccaaccgagttaactcactaacaatcacatggcttctgaactcaccaaactgatccttccatggaaagttcgcttactcatttccctcctttccaccctcrcygacacctctcgccgctccaacgccaccatcaaccgccgcctctttaacctcgctgaccgccagtcactgccaaaccccacccccgtcgacggcgtttcctcctccgacgtcaccgtcgatcccgcccgcaacctctggttccgcctcttcgtcccctcctcttcctccgccaccaccctcccggtcttcgtctacttccatggcggcgccttcgctttcttctccgcagcttcaaccccttacgacgccgtttgtcgtctctactgtcgctcccttaacgccgtcgttatctccgtcaactaccgcctcgcccctgaacaccgctacccctcccaatacgacgacggtttcgacgtcttaaaattcatcgaccgaaacggcagcgttttacccgacgttgctgacgtcaccaaatgttttttagcgggtgatagcgcgggtgcgaacctggcccaccacgtggcggttcgggtttctaaagagaagctacaaagaaccaacattatcggcttagtttcggttcaaccgtatttcggaggagaagagagaaccaaatccgaaatccaattaaaccgggcacccattatttcggtggacagaaccgattggcactggaaggtgttcttgccaaatggatcggaccgggatcatgaagcggttaacgtgagtgggcccaatgccgtggatatttcgggtttggattatccgaatacgattgtgtttatgggtgggtttgacccgttgcgtgattggcaaaggaagtattatgagtggttgagggaatcgggaaaagaggtggagttagtcgattatccaaacacgtttcatgctttttactttttttctgaattgcccgaaacttctctgtttgtttatgatgtcaaggagtttatggccaagcaaatggccaatgtgaattgaagggtattttagtacgttaattatttgtctatgttgtatatgaaggttggaggaaaaaagggaaggacatgtaacatgtattgtatgcaaatagagtattgctatgatggttgcgtgatgatatcagtttgataaatgataattgctatgcat

SEQ ID NO: 1113 - protein, 331 aa, Glycine max
  misc_feature (1)..(331): Ceres Clone ID no. 625081
  misc_feature (1)..(331): Bit score of 249.7 for HMM based on sequences of FIGURE 2.
  misc_feature (89)..(304): Pfam Name: Abhydrolase_3 Pfam Description: alpha/beta hydrolase fold
  misc_feature (75)..(130): Pfam Name: COesterase Pfam Description: Carboxylesterase
  misc_feature (1)..(331): Functional Homolog Of SEQ ID NO. 99
  misc_feature (25)..(25): Xaa is any aa, unknown, or other
MASELTKLILPWKVRLLISLLSTLXDTSRRSNATINRRLFNLADRQSLPNPTPVDGVSSSDVTVDPARNLWFRLFVPSSSSATTLPVFVYFHGGAFAFFSAASTPYDAVCRLYCRSLNAVVISVNYRLAPEHRYPSQYDDGFDVLKFIDRNGSVLPDVADVTKCFLAGDSAGANLAHHVAVRVSKEKLQRTNIIGLVSVQPYFGGEERTKSEIQLNRAPIISVDRTDWHWKVFLPNGSDRDHEAVNVSGPNAVDISGLDYPNTIVFMGGFDPLRDWQRKYYEWLRESGKEVELVDYPNTFHAFYFFSELPETSLFVYDVKEFMAKQMANVN

SEQ ID NO: 1114 - protein, 400 aa, Fragaria W ananassa
  misc_feature (1)..(400): Bit score of 665.8 for HMM based on sequences of FIGURE 2.
  misc_feature (164)..(377): Pfam Name: Abhydrolase_3 Pfam Description: alpha/beta hydrolase fold
  misc_feature (156)..(205): Pfam Name: COesterase Pfam Description: Carboxylesterase
  misc_feature (1)..(400): Functional Homolog Of SEQ ID NO. 99
MACRNRSTCLKSQLFRTRHVFCHVGMLECLTLRHSRGVECPCNIGRKERKKQRVVVMAGSNEVNLNESKRVVPLNTWVLISNFKLAYNLLRRSDGTFNRELAEFLDRKVPANTVPVDGVFSFDHVDRSTGLLNRVYQMAPANNAQWGFVNLEKPLSTTEIVPVIIFFHGGSFTHSSANSAIYDTFCRRLVNTCKAAVVSVDYRRSPEHRYPCAYDDGWSALKWVKSRTWLQSGKDSKVYVYLAGDSSGGNIAHHVAVKAAEAEVEVLGNILLHPMFAGQMRTASEVKLDGKYFVSIQDRDWYWRAFLPEGEDRDHPACNIFGPRGKGIQGLKFPKSLVVVAGLDLMQDWQLAYVEGLRNSGQDVKLLFLEEATIGFYFLPNNKHFYCLMEEMSNFVKPDC

SEQ ID NO: 1115 - protein, 330 aa, Vitis vinifera
  misc_feature (1)..(330): Public GI ID no. 147820116
  misc_feature (1)..(330): Bit score of 266.2 for HMM based on sequences of FIGURE 2.
  misc_feature (95)..(308): Pfam Name: Abhydrolase_3 Pfam Description: alpha/beta hydrolase fold
  misc_feature (89)..(114): Pfam Name: COesterase Pfam Description: Carboxylesterase
  misc_feature (1)..(330): Functional Homolog Of SEQ ID NO. 99
  misc_feature (128)..(128): Xaa is any aa, unknown, or other
  misc_feature (133)..(133): Xaa is any aa, unknown, or other
  misc_feature (155)..(155): Xaa is any aa, unknown, or other
MLDTAGGHVRASPDLPWRVRLSLAIITTISDACLRRDGTVNRRLLSFLDLKISPSDKPVNGVTTSDTTVDPSRNLWFRLFLPGEAASAGENLPVVVYFHGGGFVFLSANSKPIDDFCRRLARELPAAXVSVDXRLAPEHRCPSQYNDGFDVLKFXDENPPLHSDLTRCFIAGDSAGGNLAHHVAARASEFKFRNLKILGLIPIQPYFGGEERTESEIQLAGSPIVSVWRTDWCWKAFLPEGSDRDHPAANVFGPKSGDISGVKFPKSLVFIGGFDPLKDWQKRYCEGMKKNGKKVKVIEYPNAIHSFYGIPQLPESRLFIKEVRNFIYFE

SEQ ID NO: 1116 - protein, 346 aa, Malus x domestica
  misc_feature (1)..(346): Public GI ID no. 380040720
  misc_feature (1)..(346): Bit score of 665.1 for HMM based on sequences of FIGURE 2.
  misc_feature (108)..(323): Pfam Name: Abhydrolase_3 Pfam Description: alpha/beta hydrolase fold
  misc_feature (103)..(150): Pfam Name: COesterase Pfam Description: Carboxylesterase
  misc_feature (1)..(346): Functional Homolog Of SEQ ID NO. 99
MAGSNEVSVNESKKVVPLNTWVLISNFKLAYNLLRRADGTFNRELAEFLERKVPANVTPVDGVFSFDHVDTATGLLNRVYKFAPKNESQWGISDLEQPLSTTKVVPVIIFFHGGSFTHSSANSAIYDTFCRRLVNTCKAVVVSVNYRRSPEHRYPCAYEDGWAALKWVKSRKWLQSGKGKNSKVHVYLAGDSSGGNIAHHVAVKAAEAEVEVLGNILLHPMFGGQKRTETEKRLDGKYFVTIQDRDWYWRAFLPEGEDRDHPACHVFGPRDKSLEGLKFPKSLVVVAGFDLMQDWQLAYVEGLKNAGQDVKLRFLKQATIGFYFLPNNEHFYCLMEEVKSFVNPDC

SEQ ID NO: 1117 - protein, 344 aa, Malus x domestica
  misc_feature (1)..(344): Public GI ID no. 329756574
  misc_feature (1)..(344): Bit score of 644.6 for HMM based on sequences of FIGURE 2.
  misc_feature (108)..(321): Pfam Name: Abhydrolase_3 Pfam Description: alpha/beta hydrolase fold
  misc_feature (91)..(148): Pfam Name: COesterase Pfam Description: Carboxylesterase
  misc_feature (1)..(344): Functional Homolog Of SEQ ID NO. 99
MSGGNEVNVSESRMVVPLNTWVLISNFKLSYNLLRRPDGTFNRHLAEFLDRKVPANSNPVDGVVSFDVIIDRETSLLSRIYHPDDANLSPLNIVDPERAVSQEVLPVIVFFHGGSFAHSSSNSGIYDILCRRLVGICKAVVVSVNYRRAPENRYPCAYDDGWTALRWVNSRSWLKSTRDSNVHIYLAGDSSGGNIVHNVALRAAESGINVLGNILLNPMFGGQERTESELRLDGKYFVTIQDRDWYWRAFLPDGEDRDHPACNPFGPRGQSLEAVKFPKSLVVVAGLDLVQDWQLAYARGLESAGKNIKLMYLEQATIGFYLLPNNEHFYTVMDEISKFVLSDN

SEQ ID NO: 1118 - DNA, 2011 bp, Lycopersicon esculentum
  misc_feature (1)..(2011): Public GI ID no. 225316828
  misc_feature (1)..(2011): Encodes the peptide sequence at SEQ ID NO. 1119
aattgttcccctaaaatttgaaaacttgcccttttgtatgatgggtctgaattatgtttagctattcttcttttagtatgctgcactgtcttgtgtttcatggcatatgtataatagtttggctgatagcagcacgttctagtgttatttacagtagttctgctgtgtgtgttagatgtaattatgtaaattaaggttatcgttatgcatatatcatggcttttatcacttcaaattgtacaatttctgaaattttacctctgttttcttatagagagtggttccgctcaatacatggatcctaatttcaaacttcaagttgtcttacaatcttctccgtcgccctgatgggactttcaatcgtcacttggcagagttccttgaccgcaaggttccagcgaatgcaaatccagttgatggagtttctcttttgatgttctcattgatcgtgaaataggcctacttagccgtgtctatcggccttcttttgaggatggagcttcaccgaatatggctgaacttgaaaagcctgtgactgctgatgttgtacctgtcataattttcttccatggtggaagttttgcacactcttctttcaatagtgccatctatgacacactttgtcgccgccttgttggcatttgcaaggcagttgttgtgtcagttaattacaggcgagctcctgaaaaccgttatccttgtgcttataatgatggatggacagttcttgagtgggttaactcaagggaatggctgcggagcaaaaaggactcgaaggctcacatatacttagctggagatagctctggtggtaatattgttcataatgtggctttcagggcagtagaatccaacatagaagtgttgggaaatatactgctgaaccctatgtttggtggacaagagagaacagaatcagagaagcgattggatggcaaatattttgtcacacttcaagaccgagactggtattggagagcttatcttcctgaagattcagacagggaccatcctgcatgcaacccttttggtccaaatggtataaacctcaaaggcgtcaagttcccaaagaatcttgttgttgtcgcaggtttggaccttgttcaggattggcagttggcttatgctgatgggcttaagaaggctggacaagaggttaacctgatatatttggagaaggcaacaatagggttctacctgttgccaaataatgaacacttctacactgtcatggatgagataagtagcttcgtgagttctgactctcagtagatttaaccttgtcaaaagtaggatatgctttgaagacgtttgatgttttgttgaagttagttcctagcctgtcaaccgtttgaaagattgtatagcatcatcaattacttccttattgatcatgctattgcttggattctgctccattggctgggttggttattggtggcggaaaacctcaatcatgtagctggatctgtgttatatttattccaggtacagggagtgtctggatattggttgtatattttggtagcttgcgccaaaggttataatcatcttgtcttcgtctagcagatatgctgatttacagctaacctttcccatgttagcctccgtagtagagggggtaagtctggtgctgatccgtcaggggaccagtgccttgctaatgttatatagctgatcatactattatgcttcacggatgaacatcctaaattgtgaagttgtataatatatctataattatatagaactatgtttgcttcctcgcgttatcatggtgtgtcgccctttggtttgttttcttttttatgttctttgtcacttccttgaccttcaatatgtacatccttagatcacttatatttagaagatatgtttgcaagtactgtttcttttctcagggatgcacaatatgaacatatgtaattcaacatgcttcaattgttataagtggaattgttgttctcttgcacatgaactgatgtgctatgaggtctttctaaaaaaaaaa

SEQ ID NO: 1119 - protein, 253 aa, Lycopersicon esculentum
  misc_feature (1)..(253): Public GI ID no. 225316828
  misc_feature (1)..(253): Bit score of 499.9 for HMM based on sequences of FIGURE 2.
  misc_feature (16)..(229): Pfam Name: Abhydrolase_3 Pfam Description: alpha/beta hydrolase fold
  misc_feature (90)..(108): Pfam Name: COesterase Pfam Description: Carboxylesterase
  misc_feature (1)..(253): Functional Homolog Of SEQ ID NO. 99
MAELEKPVTADVVPVIIFFHGGSFAHSSFNSAIYDTLCRRLVGICKAVVVSVNYRRAPENRYPCAYNDGWTVLEWVNSREWLRSKKDSKAHIYLAGDSSGGNIVHNVAFRAVESNIEVLGNILLNPMFGGQERTESEKRLDGKYFVTLQDRDWYWRAYLPEDSDRDHPACNPFGPNGINLKGVKFPKNLVVVAGLDLVQDWQLAYADGLKKAGQEVNLIYLEKATIGFYLLPNNEHFYTVMDEISSFVSSDSQ

SEQ ID NO: 1120 - protein, 351 aa, Oryza sativa Indica Group
  misc_feature (1)..(351): Public GI ID no. 218185506
  misc_feature (1)..(351): Bit score of 243.5 for HMM based on sequences of FIGURE 2.
  misc_feature (99)..(325): Pfam Name: Abhydrolase_3 Pfam Description: alpha/beta hydrolase fold
  misc_feature (93)..(138): Pfam Name: COesterase Pfam Description: Carboxylesterase
  misc_feature (1)..(351): Functional Homolog Of SEQ ID NO. 99
MEKPTKKGVAPPMAWRTRLSILAAGCLTDATCRADGTINRRLLNFLDPHVPPSAAPRNGVASRDVVVDPAIPLRARLFYPCPSGGGGGTGDATKPLPVVVFFHGGGFAYLSAASRAYDAACRRIARYAGAAVLSVDYRRSPEHRYPTPYDDGLAALRFLDDPNNHPLAADDGDVPPLDVTRCFVAGDSAGANIAHHVARRYALASTTFANLRLAGLIAIQPFFGGEERTPAELRLVGAPIVSVPRTDWLWRAFLPPGADRTHEAAHAASPAGAAGIDSPAFPPATVVIGGYDPLQDWQRRYCETLRGKGKAVRVLDYPDAIHAFYIFPEFAEARDLMLRIKDIVAGGGGEH

SEQ ID NO: 1121 - protein, 328 aa, Selaginella moellendorffii
  misc_feature (1)..(328): Public GI ID no. 302769530
  misc_feature (1)..(328): Bit score of 236.2 for HMM based on sequences of FIGURE 2.
  misc_feature (82)..(305): Pfam Name: Abhydrolase_3 Pfam Description: alpha/beta hydrolase fold
  misc_feature (63)..(173): Pfam Name: COesterase Pfam Description: Carboxylesterase
  misc_feature (1)..(328): Functional Homolog Of SEQ ID NO. 99
MGDEERKSSGKQIGGFVFAEDGSYVRTPPPTGPAGFFAEVPANPSFIDGVASRDVILDKDRGLWVRVFRPEELENRSTLPIVIFYHGGGFIYMSAANAIVHRFCETLSRKLGAIVVSVNYRLAPEHRLPAAYDDGYDALKWVRGIAKSSSDQDAFAHADFSKIFVMGDSAGGNLAARVALRAAQDGIPLAGQILLQPFYGGTSRTESELKLGSSNPMITLDTTDFCWLATLPEGAADRDHPFCNPTLELPGDLARLGAGGLPRALVVVGGKDLLHDRQVEFARILEDAGNAMKLIDYENASHGFYAVGDASCQEYVLVLDEIASFLRE

SEQ ID NO: 1122 - protein, 348 aa, Brachypodium distachyon
  misc_feature (1)..(348): Public GI ID no. 357152492
  misc_feature (1)..(348): Bit score of 242.4 for HMM based on sequences of FIGURE 2.
  misc_feature (100)..(318): Pfam Name: Abhydrolase_3 Pfam Description: alpha/beta hydrolase fold
  misc_feature (90)..(118): Pfam Name: COesterase Pfam Description: Carboxylesterase
  misc_feature (1)..(348): Functional Homolog Of SEQ ID NO. 99
MAEEEEAPNPPERKPKPKPPMSRVTRLALRAVDYVADATRRDDGTLNRRLLSLLDPRVPAFSTPCRGIACRDLVLDPAHGLGARLFFHRPTLAAEALPVIVFFHGGGFAFLSACSLPYDAACRRIARYASASVLSVDYRRAPEHKFPAPYDDGFSALRFLDDPENHPSDVQLDVSRVFLAGDSAGGNIAHHVARRYAAAESSTFSNVRIKGLIAIQPFFGGEERTGSELRLDGAPIVSVGRTDWMWRAFLPPGADRSHEAACPDAAAVEEEEEFPPVLLVVGGYDPLQDWQRRYGEALRGKGKEVEVLEYPEGIHAFFLFPEFSHARDLMLRIAEFVAGSSSRGGGGE

SEQ ID NO: 1123 - protein, 415 aa, Malus x domestica
  misc_feature (1)..(415): Bit score of 668.3 for HMM based on sequences of FIGURE 2.
  misc_feature (108)..(323): Pfam Name: Abhydrolase_3 Pfam Description: alpha/beta hydrolase fold
  misc_feature (102)..(148): Pfam Name: COesterase Pfam Description: Carboxylesterase
  misc_feature (1)..(415): Functional Homolog Of SEQ ID NO. 99
  misc_feature (412)..(412): Xaa is any aa, unknown, or other
MAGSNEVNVNESKKVVPLNTWVLISNFKLAYNLLRRADGTFNRELAEFLDRKVPANTVPVDGVFSFDHVDRATGLLNRVYQFAPQNESQWGIVDLEQPLSTTKVVPVIIFFHGGSFTHSSANSAIYDTFCRRLVNTCKAVVVSVNYRRSPEHRYPCAYEDGWAALKWVKSRKWLQSGKGKDLKVHVYLAGDSSGGNIAHHVAVKAAEAEVEVLGNILLHPMFAGQKRTESEKRLDGKYFVTIQDRDWYWRAFLPEGEDRDHPACHVFGPRDKSLEGLKFPKSLVVVAGFDLMQDWQLAYVEGLKNAGQDVKLLFLKQATIGFYFLPNNEHFYCLMEEMKTFVNPDWFCSAASEPYVRVLVSAAGKDWNSFIGFGIATGCKSRRRTCHGDATLSVSQKHMAVRDMTWDAARVXFPV

SEQ ID NO: 1124 - protein, 233 aa, Carica papaya
  misc_feature (1)..(233): Bit score of 356.2 for HMM based on sequences of FIGURE 2.
  misc_feature (108)..(209): Pfam Name: Abhydrolase_3 Pfam Description: alpha/beta hydrolase fold
  misc_feature (98)..(147): Pfam Name: COesterase Pfam Description: Carboxylesterase
  misc_feature (1)..(233): Functional Homolog Of SEQ ID NO. 99
MARSNEVNLSESKLVVPLNTWVLISNFKLAYNLLRRPDGTFNRHLAEFLDRKVSANANPVDGVFSFDVIIDRETGLLTRIYRPVDAEEPHASIVELEKPVNGDIVSVIIFFHGGSFAHSSANSAIYDMLCRRLVGLCKAVVVSVNYRRAPENRYPCAYDDGWTALNWVNSRSWLRSKKDSKVHIYLAGDSSGGCLTLTLFGSVLDLHQQHHERQGRVQFQICSKGKRMIGGRE

SEQ ID NO: 1125 - protein, 330 aa, Physcomitrella patens subsp. patens
  misc_feature (1)..(330): Public GI ID no. 168029383
  misc_feature (1)..(330): Bit score of 265.7 for HMM based on sequences of FIGURE 2.
  misc_feature (81)..(307): Pfam Name: Abhydrolase_3 Pfam Description: alpha/beta hydrolase fold
  misc_feature (67)..(146): Pfam Name: COesterase Pfam Description: Carboxylesterase
  misc_feature (1)..(330): Functional Homolog Of SEQ ID NO. 99
MELWSLRLLSRMLHAFDNLCIRKDGTVNRKWDKFLGTQVPANPQAKCGVSTVDVIVDFEKDVWVRLFIPKKPQAQKLFPIIFFYHGGGFVFLSPDSVCYDTFCRRLARKCHALVISVHYRQELLTTPEHKFPAAYDDCFAALEWLQSGQATQCLPRSIDPRCIDLSRVFLCGDSAGGNIAHHVAVRASETEISPLCIKGVMLLSPFFGGQERTPAEIRVRNVPMVSVKRLDWYWKSFLPHGANRDHPACNIFGRNSPDLSDVSLPSVLIIIGGLDILQDWETRYADCLNRAGKDVKVFFYKNGIHSFGLFDQTHITKQMFFNIMGFIDNH

SEQ ID NO: 1126 - protein, 336 aa, Oryza sativa Indica Group
  misc_feature (1)..(336): Public GI ID no. 125559371
  misc_feature (1)..(336): Bit score of 225.4 for HMM based on sequences of FIGURE 2.
  misc_feature (86)..(308): Pfam Name: Abhydrolase_3 Pfam Description: alpha/beta hydrolase fold
  misc_feature (72)..(128): Pfam Name: COesterase Pfam Description: Carboxylesterase
  misc_feature (1)..(336): Functional Homolog Of SEQ ID NO. 99
MTRRRRSPSLPCAVRVQAAGFALGHRRDGSVRRLFFSLLDIHVRAKRRRPDAAGVRSVDVTIDASRGLWARVFSPSPTKGEALPVVVFFHGGGFVLFSAASFYYDRLCRRICRELRAVVVSVNYRLAPAHRFPAAYDDGLAALRYLDANGLPEAAAVDLSSCFLAGDSAGGNMVHHVAQRWAASASPSSTLRLAGAVLIQPFFGGEERTEEELELDKAALTLSLARTDYYWREFLPEGATRDHPAAHVCGGGGGEHDVEVAEAFPAAMVAIGGFDLLKGWQARYVEALRGKGKAVRVVEYPGAIHGFCLFPELADSGELVEEMKLFVQEHRTKRVQ

SEQ ID NO: 1127 - protein, 340 aa, Medicago truncatula
  misc_feature (1)..(340): Public GI ID no. 357498899
  misc_feature (1)..(340): Bit score of 289.4 for HMM based on sequences of FIGURE 2.
  misc_feature (98)..(314): Pfam Name: Abhydrolase_3 Pfam Description: alpha/beta hydrolase fold
  misc_feature (62)..(140): Pfam Name: COesterase Pfam Description: Carboxylesterase
  misc_feature (1)..(340): Functional Homolog Of SEQ ID NO. 99
MSTNKPKPVLPWKVRATISLLTVLTDSSCRANGTVNRRLFNFFDLKSSPNATPINGVSTKDVTVNSENNLWFRLFTPTVAGEVTEDGGSTKTTSLPVVIFFHGGGFTFLSSSSNLYDAVCRRLCREISAVIVSVNYRLAPEHRYPSQYEDGEAVLRFLDENVTVLPENTDVSKCFLAGDSAGGNLVHHVAVRACKAGLQNICVIGSILIQPFFGGEERTEAEIRLVGMPFVSVARTDWMWKVFLPEGSDRDHGAVNVCGPNAEDLSGLDYPDTLVFVGGFDPLIDWQKRYYDWLKKCGKKAELIEYPNMVHGFHVFPDFPESTQLIMQVKDFINKVSNSK

SEQ ID NO: 1128 - protein, 360 aa, Brachypodium distachyon
  misc_feature (1)..(360): Public GI ID no. 357116242
  misc_feature (1)..(360): Bit score of 230.1 for HMM based on sequences of FIGURE 2.
  misc_feature (111)..(332): Pfam Name: Abhydrolase_3 Pfam Description: alpha/beta hydrolase fold
  misc_feature (98)..(153): Pfam Name: COesterase Pfam Description: Carboxylesterase
  misc_feature (1)..(360): Functional Homolog Of SEQ ID NO. 99
MEASKTKESQGAAADDEIQPRPAAASPPALPWTVRLQVLALVTATDLSQRRDGTVNRFLFSLGDRQTPARARPDALGVRSADVTVDASRNLWARVYSRSSSGSSAVPVPVVVYFHGGGFAFLSAASTPLDGMCRRLCRELGAVVVSVNYRLAPEHKFPAAYDDGEAVFRHLAANNDIFPVPVDLSRCFLAGDSAGGNIAHHVAHRWTSDAEPDPVVFRLAGIILLQPYFGGEERTAAELSLEGVAPVVNMRRSDWSWKAFLPVGADRNHPAAHVTGEAAPEPELGENFPPAMVAVGGLDPLQDWQRRYAAMLRRKGKAVRVVEFPEAIHAFYCFPELPDSGKLVEDVKAFIDRNGGTRVL

SEQ ID NO: 1129 - protein, 344 aa, Malus x domestica
  misc_feature (1)..(344): Public GI ID no. 380040724
  misc_feature (1)..(344): Bit score of 650.0 for HMM based on sequences of FIGURE 2.
  misc_feature (108)..(321): Pfam Name: Abhydrolase_3 Pfam Description: alpha/beta hydrolase fold
  misc_feature (91)..(148): Pfam Name: COesterase Pfam Description: Carboxylesterase
  misc_feature (1)..(344): Functional Homolog Of SEQ ID NO. 99
  misc_feature (76)..(76): Xaa is any aa, unknown, or other
MAGGNEVNVNESRVVVPLNTWVLISNFKLSYNLLRRPDGTFNRHLAEFLDRKVPANAKPVDGVVSFDVIIDRETSXLSRIYHPDNADLSPLNIVDLKRPVNKEVLPVIVFFHGGSFVHSSSNSGIYDILCRRLVGVCKAVVVSVNYRRAPENRYPCAYDDGWTALKWVKSRPWLKSTKDSKVHIYLAGDSSGGNIVHNVALRAVEFGINVLGNILLNPMFGGQERTESEMRLDGKYFVTIQDRDWYWRALLPEGEDRDHPACNPFGPRGQSLEAVKFPKSLIVVAGLDLIQDWQLAYARGLERAGINVKLMYLEHATIGFYLLPNNEHFYTVMDEISKFVCSDY

SEQ ID NO: 1130 - protein, 387 aa, Malus x domestica
  misc_feature (1)..(387): Bit score of 627.4 for HMM based on sequences of FIGURE 2.
  misc_feature (151)..(364): Pfam Name: Abhydrolase_3 Pfam Description: alpha/beta hydrolase fold
  misc_feature (134)..(191): Pfam Name: COesterase Pfam Description: Carboxylesterase
  misc_feature (1)..(387): Functional Homolog Of SEQ ID NO. 99
  misc_feature (54)..(54): Xaa is any aa, unknown, or other
MSLKIPDAIRTFVNFDGIFTSFFLGLPESSNGVAAAAIADIDICKKFMESDALXLQMVVPLNTWVLISNFKLSYNLLRRPDGTFNRHLAEFLDRKVPANSNPVDGVVSFDVIIDRETSLLSRIYHPDDANLSPLNIVDPERAVSQEVLPVIVFFHGGSFAHSSSNSGIYDILCRRLVGICKAVVVSVNYRRAPENRYPCAYDDGWTALRWVNSRSWLKSTRDSNVHIYLAGDSSGGNIVHNVALRAAESGINVLGNILLNPMFGGQERTESELRLDGKYFVTIQDRDWYWRAFLPDGEDRDHPACNPFGPRGQSLEAVKFPKSLVVVAGLDLVQDWQLAYARGLESAGKNIKLMYLEQATIGFYLLPNNEHFYTVMDEISKFVLSDN

SEQ ID NO: 1131 - protein, 335 aa, Arabidopsis lyrata subsp. lyrata
  misc_feature (1)..(335): Public GI ID no. 297812501
  misc_feature (1)..(335): Bit score of 233.7 for HMM based on sequences of FIGURE 2.
  misc_feature (90)..(307): Pfam Name: Abhydrolase_3 Pfam Description: alpha/beta hydrolase fold
  misc_feature (78)..(132): Pfam Name: COesterase Pfam Description: Carboxylesterase
  misc_feature (1)..(335): Functional Homolog Of SEQ ID NO. 99
MATDSQPNQKLTLPLKTRIALTVISTMTDNAQRPDGTINRRFLRLFDFRAPPNPKPVNSVSTSDFVVDQSRDLWFRLYTPHVSGDKIPVVVFFHGGGFAFLSPNAYPYDNVCRRFARKLPAYVISVNYRLAPEHRYPAQYDDGYDALKFLEENHGKVLPANADLSRCFFAGDSAGGNIAHNVAVRICREPRGCFTAVKLIGLISIQPFFGGEERTEAEKRLVGAPLVSPGRTDWCWKAMGLNRDHEAVNVGGPNAVDISDLEYPETMVVVAGFDPLQDWQRSYYEWIKLSGKRATLIEYPNMFHAFYIFPELPESGQLIMRIKDFVAERVASLSA

SEQ ID NO: 1132 - DNA, 1754 bp, Glycine max
  misc_feature (1)..(1754): Public GI ID no. 210144144
  misc_feature (1)..(1754): Encodes the peptide sequence at SEQ ID NO. 1133
gccaatagcttttgtgattgtcaagttgcgaagcgcgttgcggatctgtaatcggaaatactggatcgttccaatggctgggagtaacgagcttaaccccaacgattctaagatggtggttccgctgaatatgtgggttctgatctcaaatttcaagttggcatacaatcttcttcgtcgcccggacggtactttcaaccgggacttagcagagttccttgatcggaaggttcccgcaaatgccaaccctgtggacagagtgttctcctttgatgttgttgttgaccgtgaaacgaatcttctgactcgaatctatcgtcctactgagggagaagaacgttcggtgaacattcttgaccttgagaagcctgtgagctctgaggttgttcctgtcatcatatttttccatggtggaagttttgcgcattcttcagccaatagtgctatatatgacaccctttgtcgtcgcctagtgggtatctgtaaggctgttgtggtgtctgtgaactataggcgtgcacctgagaataggtatccctgtgcatatgatgatgggtggacagctcttaagtgggttagttctagatcttggctccagagtaagaaggataagaaagttcatatctacttggctggggatagctcaggtgggaacattgtgcaccatgttgccctcaaggccgtggagtcgggaattgaagtgtttgggaatattctgctcaacccattgtttggtgggcaagaaagaaccgagtctgagaagcgcttagatgggaggtattttgttagagttaaggatcgagactggtattggagggcttttcttcctgaaggggaagatagagaccaccatgcatgcaacccgtttggccccaaggggaagagtcttgaagggatcacctttcccaagagccttgtggtggttgctggtttagaccttgttcaggactggcaattgggttatgccaaagggcttgagaaggctggccaagaagtgaaattgattttcctggagcaagcaaccattgggttttatttgctgccaaacaatgagcacttctctcctgttatggatgagataaaatattttttcagctctgactgttgataggcttaacttttgctataatacacaacaagtggacgttagaagattgtgtaggaaataggtatgctactaaacctttttttccttttttctttttgggttctttgctgtaggactctgctcccgctattaggtacttgtatgctactaaatgtgtctgagattggtgtaatcagcatatagctgtatgatgcttttccggagcacataatgaggaaattgggtgctgcggataggtgaaagctttttaggacaaaaaggagaggaaggtgttattctatttctgggcgtgaccttgatgccaatcaggtggggcttgtcgttgtctgacaagtgttatatatatatatatatatataactaattttggaactcggataggaaaatatcaataatatgttggtgctgttaggttatatacgtctgtgctatctccatgagtgtttgttttaagactgtttactttttttctctatatagctaatttgacattcctatgtcttgggttgggtttgtccttgttggatgatggacactccttgcaaatgtaaatggatggatgtcttttccgcagcaatgtttaaggcttgtattatgtttgcttctgtatatatagatatttttcagcaaaaaaaaaaaaaaaaaa

SEQ ID NO: 1133 - protein, 344 aa, Glycine max
  misc_feature (1)..(344): Public GI ID no. 210144144
  misc_feature (1)..(344): Bit score of 652.2 for HMM based on sequences of FIGURE 2.
  misc_feature (108)..(321): Pfam Name: Abhydrolase_3 Pfam Description: alpha/beta hydrolase fold
  misc_feature (91)..(147): Pfam Name: COesterase Pfam Description: Carboxylesterase
  misc_feature (1)..(344): Functional Homolog Of SEQ ID NO. 99
MAGSNELNPNDSKMVVPLNMWVLISNFKLAYNLLRRPDGTFNRDLAEFLDRKVPANANPVDRVFSFDVVVDRETNLLTRIYRPTEGEERSVNILDLEKPVSSEVVPVIIFFHGGSFAHSSANSAIYDTLCRRLVGICKAVVVSVNYRRAPENRYPCAYDDGWTALKWVSSRSWLQSKKDKKVHIYLAGDSSGGNIVHHVALKAVESGIEVFGNILLNPLFGGQERTESEKRLDGRYFVRVKDRDWYWRAFLPEGEDRDHHACNPFGPKGKSLEGITFPKSLVVVAGLDLVQDWQLGYAKGLEKAGQEVKLIFLEQATIGFYLLPNNEHFSPVMDEIKYFFSSDC

SEQ ID NO: 1134 - DNA, 1297 bp, Triticum aestivum
  misc_feature (1)..(1297): Ceres Clone ID no. 568611
  misc_feature (1)..(1297): Encodes the peptide sequence at SEQ ID NO. 1135
aacggagagaatggccggcgacgtcgcgcgcagggagctccgggcgcgcgtgggggcgatgccgtgggcggtgcggctccagctgcgcgcgctcgaggccgccgtcgacgccacgcagcgccgggacggcaccgtcaaccgcttcctcttctcgctgctcgtggaccgccaggcgcccgccaaccccgcgcgcgccgacgccgggggcgtccgctccgtggacgtcaccgtcgacgcgtccaccggcgtgcgggcccgcgtctactttacggccggggcgggggcggaggcagacgcgtcgccgcgccccgtgatcgtctacttccacggcggcggcttcacggtgttctccgcggccacccggccctacgacgagctctgccgcaccatgtgccgcgagacgggcgccgtcgtcgtgtccgtgacctaccgcctcgcgcccgagcaccgctaccccgcggcctacgacgacggggaggccgccctccggtacctcgccaccaccggcctgcccgccgaggtccccgtccgcgtcgacctctcccgctgcttcctcgccggcgacagcgccggcgccaacatcgcgcaccacgtggcccagcgctggacggcggcacccgcgacaacgcctccagccgtccacctcgccggcctcctgctcctgtcctcctacttcggcggagaggaccggaccgagtcggagcaagcgctggagggcgtggccccgatcgtgaacctccgccggtccgacttctggtggaaggcgtacttgccggagggcgccgaccgaaaccacccggccgcgcacgtgacgggcgaggccggcccggagccggagctgccggatgcgttcccgcgggcgatggtggtcgtcggcgggctcgacccgctccaggactgggggaggcggtacgccggcatgctgcgccggaagggcaaggaggtgcgcgtgatggagttcacggaggctgtacacgccttctacttcttcccggcgctgcccgagaccggcaagctcgtcgcggagatctcggcgttcgtggagagcaccgcgccgagctcgaccgcctagagaactagagacgatgattaggacaactcgtcgtggatctcgtacgtccccgtctctgctgatgttatattgttggctgatagcctatttcactgtcgaagtcgctgcgagcagccgcgtctgttaaattattacactgtggtgtataagttcgagttgccatctcgatattttctttgtgcaacatgtggcatgggtgatggggacatggcagtgatggcacct

SEQ ID NO: 1135 - protein, 353 aa, Triticum aestivum
  misc_feature (1)..(353): Ceres Clone ID no. 568611
  misc_feature (1)..(353): Bit score of 244.8 for HMM based on sequences of FIGURE 2.
  misc_feature (102)..(325): Pfam Name: Abhydrolase_3 Pfam Description: alpha/beta hydrolase fold
  misc_feature (97)..(144): Pfam Name: COesterase Pfam Description: Carboxylesterase
  misc_feature (1)..(353): Functional Homolog Of SEQ ID NO. 99
MAGDVARRELRARVGAMPWAVRLQLRALEAAVDATQRRDGTVNRFLFSLLVDRQAPANPARADAGGVRSVDVTVDASTGVRARVYFTAGAGAEADASPRPVIVYFHGGGFTVFSAATRPYDELCRTMCRETGAVVVSVTYRLAPEHRYPAAYDDGEAALRYLATTGLPAEVPVRVDLSRCFLAGDSAGANIAHHVAQRWTAAPATTPPAVHLAGLLLLSSYFGGEDRTESEQALEGVAPIVNLRRSDFWWKAYLPEGADRNHPAAHVTGEAGPEPELPDAFPRAMVVVGGLDPLQDWGRRYAGMLRRKGKEVRVMEFTEAVHAFYFFPALPETGKLVAEISAFVESTAPSSTA

SEQ ID NO: 1136 - protein, 354 aa, Hordeum vulgare subsp. vulgare
  misc_feature (1)..(354): Public GI ID no. 326527329
  misc_feature (1)..(354): Bit score of 237.5 for HMM based on sequences of FIGURE 2.
  misc_feature (102)..(326): Pfam Name: Abhydrolase_3 Pfam Description: alpha/beta hydrolase fold
  misc_feature (96)..(144): Pfam Name: COesterase Pfam Description: Carboxylesterase
  misc_feature (1)..(354): Functional Homolog Of SEQ ID NO. 99
MSGDVARKELRARVGAMPWAVRLQLRALEAAVDATQRRDGTVNRFLFSLLVDRQAPANPARADAGGVRSVDFTVDASTGVPARVYFAAAAGAEAEASPHPVIVYFHGGGFTVFSAATRPYDVLCRTICRETGAVVVPVTYRLAPEHRYPAAYDDGEAALRYLATTGLPAEVPVRVDLSRCFLAGDSAGANIAHHVAQRWTAAPAATTPPAIHLVGLLLLSAYFGGEDRTESEKALEGVAPIVNLRRSDFWWKAFLPEGADRNHPAAHVTGEAGPEPELPDAFPPAMVVVGGLDPLQEWGRLYAAMLRRKGKEVRVVEFTEAVHAFYFFPALPDTGKLVGEIRAFVESIAPRSTA

SEQ ID NO: 1137 - DNA, 918 bp, Populus balsamifera subsp. trichocarpa
  misc_feature (1)..(918): Ceres Annot ID no. 1483390
  misc_feature (1)..(918): Encodes the peptide sequence at SEQ ID NO. 1138
atggcagaaacaccaagaactcttcgcctctcattgaagaccaggctcctcctcgccgcccactcctttgggattcgcgccgccagccgttccgaccacaccgtaaaccgcagcgtattgaacatcttcgaccccaaggccgctgcttccgccaaaccagtcaatggggtctcctctttcgacaacactattgaccctacccgcaacctgtggttccgcctctacgcccccacatccaccgccactacggatgctctgcctgtgatcatattctttcatggtgggggcttcgcattcatggcggctaactcaaaatcttttgacgtactctgccggcgacttgcacgtgaaattaatgcagttgttatctctgttaactatcggcttgctcctgagtacaagtacccatgccagtgttttatagcaggtgatagtgcagggggtaacttggctcatcacgtcgtgctcaaagcttgtgaacacacattttctaacataaagatcaagggactcatagcaatgcagccatttttcggaggggaagaaaggacagaatcagaaatcaagcttgttggggttcctttaatatcagtggaacgtacagactggatgtggaaagcgtttctgcctgagggatcggaccgaaaccactcggtggttaatgttttcggaccaaatgcggtggatatttcaggcgtgaagttccctgctacgttactctttgtcggagggttcgatcccttgcaagattggcagaagaggtaccatgaggggctgaagaaatctgggaaagaagtacatttggtagagtatccaaatgtttttcatgggttttattgcctacctgaatcgcctgaattttctttgttgatcggtgaggtgaagagttttgtgcaaaagcagtcatctcttacatag

SEQ ID NO: 1138 - protein, 305 aa, Populus balsamifera subsp. trichocarpa
  misc_feature (1)..(305): Ceres Annot ID no. 1483390
  misc_feature (1)..(305): Bit score of 162.3 for HMM based on sequences of FIGURE 2.
  misc_feature (89)..(138): Pfam Name: Abhydrolase_3 Pfam Description: alpha/beta hydrolase fold
  misc_feature (75)..(131): Pfam Name: COesterase Pfam Description: Carboxylesterase
  misc_feature (1)..(305): Functional Homolog Of SEQ ID NO. 99
MAETPRTLRLSLKTRLLLAAHSFGIRAASRSDHTVNRSVLNIFDPKAAASAKPVNGVSSFDNTIDPTRNLWFRLYAPTSTATTDALPVIIFFHGGGFAFMAANSKSFDVLCRRLAREINAVVISVNYRLAPEYKYPCQCFIAGDSAGGNLAHHVVLKACEHTFSNIKIKGLIAMQPFFGGEERTESEIKLVGVPLISVERTDWMWKAFLPEGSDRNHSVVNVFGPNAVDISGVKFPATLLFVGGFDPLQDWQKRYHEGLKKSGKEVHLVEYPNVFHGFYCLPESPEFSLLIGEVKSFVQKQSSLT

SEQ ID NO: 1139 - protein, 343 aa, Ricinus communis
  misc_feature (1)..(343): Public GI ID no. 255553969
  misc_feature (1)..(343): Bit score of 256.0 for HMM based on sequences of FIGURE 2.
  misc_feature (97)..(316): Pfam Name: Abhydrolase_3 Pfam Description: alpha/beta hydrolase fold
  misc_feature (83)..(138): Pfam Name: COesterase Pfam Description: Carboxylesterase
  misc_feature (1)..(343): Functional Homolog Of SEQ ID NO. 99
MASKTEKEALPPPRAALPWRTRLVVSLISVISDAARRSDGTINRRLFSFFDFKAPPSPTKPIRSVISSDTMVDSDRNLWYRMYTPTDSTKEDNLPVMIFFHGGGFSFLSPANTSYDIVCRRFARRLPAIVVSVDYRLTPEHRFPSQYDDGFDVLKFLDDNHTTLLPPNARLSTCFLAGDSAGANIAHHVAVRACRHGTSFSVAKIVGLVSIQPFFGGEERTSSENRLTGSLLVSVPRTDWCWKVFLPEGSSRDHYAVNVSGPNAEDISGLDYPATLVFVGGLDPLQDWQRRYYDWLKRSGKEATLIDYPDMIHAFYIFPELPESSQLFSQVKDFVLHILSQQL

SEQ ID NO: 1140 - protein, 331 aa, Penicillium chrysogenum
  misc_feature (1)..(331): Public GI ID no. 124829
  misc_feature (1)..(331): Bit score of 27.6 for HMM based on sequences of FIGURE 5.
  misc_feature (39)..(56): Pfam Name: 2OG-FeII_Oxy Pfam Description: 2OG-Fe(II) oxygenase superfamily
  misc_feature (1)..(331): Functional Homolog Of SEQ ID NO. 287
MASTPKANVPKIDVSPLFGDNMEEKMKVARAIDAASRDTGFFYAVNHGVDVKRLSNKTREFHFSITDEEKWDLAIRAYNKEHQDQIRAGYYLSIPEKKAVESFCYLNPNFKPDHPLIQSKTPTHEVNVWPDEKKHPGFREFAEQYYWDVFGLSSALLRGYALALGKEEDFFSRHFKKEDALSSVVLIRYPYLNPIPPAAIKTAEDGTKLSFEWHEDVSLITVLYQSDVANLQVEMPQGYLDIEADDNAYLVNCGSYMAHITNNYYPAPIHRVKWVNEERQSLPFFVNLGFNDTVQPWDPSKEDGKTDQRPISYGDYLQNGLVSLINKNGQT

SEQ ID NO: 1141 - protein, 318 aa, Carica papaya
  misc_feature (1)..(318): Public GI ID no. 7595984
  misc_feature (1)..(318): Bit score of 148.9 for HMM based on sequences of FIGURE 5.
  misc_feature (158)..(253): Pfam Name: 2OG-FeII_Oxy Pfam Description: 2OG-Fe(II) oxygenase superfamily
  misc_feature (1)..(318): Functional Homolog Of SEQ ID NO. 287
MENFPVIDLSKLNGEERASTMELIHDACENWGFFELVNHGISHDLMDTVERLTKEHYKKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVRNYPPCPKPDLIKGLRAHTDAGGIILVFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 1142 - protein, 343 aa, Glycine max
  misc_feature (1)..(343): Public GI ID no. 356571007
  misc_feature (1)..(343): Bit score of 391.9 for HMM based on sequences of FIGURE 5.
  misc_feature (175)..(278): Pfam Name: 2OG-FeII_Oxy Pfam Description: 2OG-Fe(II) oxygenase superfamily
  misc_feature (1)..(343): Functional Homolog Of SEQ ID NO. 287
MVVPSPSPTSIKTSYKKKKTIIKIPTIDLSMERTELSETVVKACEEYGFFKVVNHNVPKEVIARMEEEGAEFFGKATYEKRGAGPASPFGYGFSNIGPNGDMGDLEYLLLHANPLSVSERSKTIANDSTKFSCVVNDYVEAVKEVTCEILDLVVEGLGVPDKFALSRLIRDVNSDSVLRINHYPPLNQKVKGNKNSIGFGAHSDPQILTIMRSNDVGGLQIYTRDGLWIPVPPDPNQFFVMVGDVFQVLTNGKFMSVRHRALTNTLKARMSMMYFAAPPLDWWITPLPKMVSPPQNPSLYKPFTWAQYKKATYSLRLGDSRLDLFKAQLDTHHVSASPSQIQC

SEQ ID NO: 1143 - protein, 355 aa, Brachypodium distachyon
  misc_feature (1)..(355): Public GI ID no. 357134283
  misc_feature (1)..(355): Bit score of 408.5 for HMM based on sequences of FIGURE 5.
  misc_feature (195)..(303): Pfam Name: 2OG-FeII_Oxy Pfam Description: 2OG-Fe(II) oxygenase superfamily
  misc_feature (1)..(355): Functional Homolog Of SEQ ID NO. 287
MVVLAQGELEQIALPAVQKAAPPLADVPEIDLAAAGAGGSAAGRAAAAKAVAAACEEHGFFKVTGHGVASGLLARVEAAAADFFALPQREKEAAMAMAMAPAAAAAGSSPFGYASKRIGSNGDLGWVEYLLLGVTAAGAPLPVPSSASLCAFRELLDEYTVAVRRMTCEVLELMAEALGMEKDEFTRLVLEEDSDSMLRVNHYPPAPRPELKQQLQHGGNGRVTGFGEHTDPQIISVLRSNATSGLEIALRDGTWVSVPPDHTSFFVNVGDALQVLTNGRFRSVRHRVMVNSVRSRVSVIFFGGPAPGKTLAPLPRMVGEGGSSRYREFTWREYKASAYRTKLAENRLCHFETTS

SEQ ID NO: 1144 - protein, 328 aa, Rhodococcus opacus PD630
  misc_feature (1)..(328): Public GI ID no. 356660541
  misc_feature (1)..(328): Bit score of 90.6 for HMM based on sequences of FIGURE 5.
  misc_feature (166)..(267): Pfam Name: 2OG-FeII_Oxy Pfam Description: 2OG-Fe(II) oxygenase superfamily
  misc_feature (1)..(328): Functional Homolog Of SEQ ID NO. 287
MLPVIDFAELDTPAGRERLREITHHVGFFYLDGHGVARELLDRVFTVAREFFALPDDSKQSIAMLNSPHFRGYNRVGGELTNGETDWREQIDIGPERQPIPGADGYLRLQGPNQWPADLPDLEKTIEALDAALADVGMRLLRHWAASLDADPAIFDDAFAHAPATLIKVVRYPERPSADHTGEQGVGAHKDSGVLTMLLLEPGSSGLQVETEDGDWIDAPARAGSFVVNIGELLEVATGGYLRATRHRVLTPAGAPERLSVPYFLNPALDATVPTIGLPPHLAERARGIELDPANPLYRTYGENAWKSRTRAHPDVYQRWYPGEAEPE

SEQ ID NO: 1145 - protein, 244 aa, Oryza sativa Indica Group
  misc_feature (1)..(244): Public GI ID no. 218188130
  misc_feature (1)..(244): Bit score of 233.8 for HMM based on sequences of FIGURE 5.
  misc_feature (62)..(180): Pfam Name: 2OG-FeII_Oxy Pfam Description: 2OG-Fe(II) oxygenase superfamily
  misc_feature (1)..(244): Functional Homolog Of SEQ ID NO. 287
MFQRSSGIEARVENMELTYQVVNDYVEAVRQLACHVLDLLGEGLGLRDPTSLTRLITATDNDSLIRINHYPPSCAAAAGDHKSGGGPAPTAAIGFGEHTDPQILSVLRANDADGLQLLLPDAAAAGDSVWVPVPPDPSAFFVNVGDLLQALTNGRLVSIRHRVVAGTGKPRLSTIYFAAPPLHARISALPETVAAGAPRRYRAFTWAEYKRTMYTLRLSHNRLDLFHAGDGDGDAGVGDDDDHE

SEQ ID NO: 1146 - protein, 330 aa, Glycine max
  misc_feature (1)..(330): Public GI ID no. 356558109
  misc_feature (1)..(330): Bit score of 348.7 for HMM based on sequences of FIGURE 5.
  misc_feature (164)..(271): Pfam Name: 2OG-FeII_Oxy Pfam Description: 2OG-Fe(II) oxygenase superfamily
  misc_feature (1)..(330): Functional Homolog Of SEQ ID NO. 287
MVAASPISIRSEKISPIDLPMVDLTGERSMVKKLIVKACEEYGFFNVINHGVPRDTIAKMEEAAFDFFAKPMAQKKQVALYGCKNIGFNGDMGEVEYLLLSATPPSVAHLKNISNVPSNFSSSVSAYTEGVRELACEILELMAEGLGVPDTWFFSRLIREVDSDSVLRFNHYPPIILNKDCFKDNHNHTKVIGFGEHSDPQILTILRSNDVPGLQISLQDGVWNPVAPDPSAFCVNVGDLLQVMTNGRFLSVRHRAMTNSHKSRMSVAYFGGPPLDACIVAPPVMVTSKRPSLLFKPFTWAEYKKVTYSMKLGERRIDFFRKCTTQQQIE

SEQ ID NO: 1147 - protein, 343 aa, Mycobacterium massiliense CCUG 48898
  misc_feature (1)..(343): Public GI ID no. 365872403
  misc_feature (1)..(343): Bit score of 75.8 for HMM based on sequences of FIGURE 5.
  misc_feature (30)..(63): Pfam Name: 2OG-FeII_Oxy Pfam Description: 2OG-Fe(II) oxygenase superfamily
  misc_feature (1)..(343): Functional Homolog Of SEQ ID NO. 287
MGYFLMAVKTVAPKRLASNHGHVAELPVIDLSSDPNQLRAALRQVAHEVGFFYLTGHGVSPQLVHEVLSAARKLFALSEADKEAIAMVRSPHFRGFTRLGGELTGGLTDWREQIDVGPERAASPTAHGHDYMWLQGPNQWPAAVPEFRPALESWDIALAEVGRKLLREWAIALGSDGAVFSEAFGDEPAMLIKVIRYPPDGTTAQGVGAHRDSGVLTLLLTEPGVGGLQVEVDGAWLEVPGREGAFIVNIGELLERASGGYLRATRHRVTLTGAPRISVAYFFNPRLDARIPVLELPPELRDRARGVSADPGDPIHATYGENAWKSRLRAHPDVAAAHGHLDS

SEQ ID NO: 1148 - protein, 336 aa, Mycobacterium intracellulare MOTT-02
  misc_feature (1)..(336): Public GI ID no. 379749536
  misc_feature (1)..(336): Bit score of 80.7 for HMM based on sequences of FIGURE 5.
  misc_feature (31)..(48): Pfam Name: 2OG-FeII_Oxy Pfam Description: 2OG-Fe(II) oxygenase superfamily
  misc_feature (1)..(336): Functional Homolog Of SEQ ID NO. 287
MPGVTAVPVVDLRADPARLRDGLREAAHRVGFFYLTGHGVAPELVTRMLEAARRLFALPQHDKDSVAMVRSPHFRGYTRLGGEVTRGEVDWREQIDIGPQRPPIGGLGKSDYRWLQGPNQWPAALPELPGLVEEWDAALSAVARTLLRHWAASLGSPADVFDPAFAETPATLIKIIRYPGRAAGSQGVGAHRDAGVLTLLLAEPGSRGLQVRRAFDGAWIDVPPREGAFIVNIGELLEAATRGYLRATEHRVNLQGPATDRISVPYFFNPRLDARIPVLALPRELAAGTGTDWAASQDPADPIFSVYGRNAWKSRLRSHPDVASAHGYWAERLENE

SEQ ID NO: 1149 - protein, 321 aa, Streptomyces cattleya
  misc_feature (1)..(321): Public GI ID no. 6016387
  misc_feature (1)..(321): Bit score of 35.2 for HMM based on sequences of FIGURE 5.
  misc_feature (183)..(286): Pfam Name: 2OG-FeII_Oxy Pfam Description: 2OG-Fe(II) oxygenase superfamily
  misc_feature (1)..(321): Functional Homolog Of SEQ ID NO. 287
MPVLMPSADVPTIDISPQLFGTDPTPRRTSRGRSTRPARGSGFFYASHHGIDVRRLQTWSNESTTMTDQRSTTWRSTRYNENNSHVRNGYYMARPGRETVESWCYLNPSFGEDHPMMKAGTPMHEVNVWPDEERHPDFGSFGEQYHREVSASRRCCCGASRWRRQAGESSSNEVTEEDTLSAVSMIRYPYLDPYPEAAIKTGPDGTRLSFEDHLDVSMITVLSKTEVQNLQVETVDGWQSLPTSGENFLINCGTYLGYLTNDYFPAPNHRVKYVNAERLSLPFFLHAGQNSVMKPFTRRTGDRKLNPAVTYGEYLQEGFTR

SEQ ID NO: 1150 - protein, 344 aa, Scopolia parviflora
  misc_feature (1)..(344): Public GI ID no. 66735505
  misc_feature (1)..(344): Bit score of 152.8 for HMM based on sequences of FIGURE 5.
  misc_feature (195)..(292): Pfam Name: 2OG-FeII_Oxy Pfam Description: 2OG-Fe(II) oxygenase superfamily
  misc_feature (1)..(344): Functional Homolog Of SEQ ID NO. 287
MATLVSNWSSNNVSESFIAPLEKRAEKDVPLGNDVPMIDLQQEHHLVVQQITKACQDFGLFQVINHGFPEKLMAETMKVCKEFFALPAEEKEKLQPKGEPAKFELPLEQKAKLYIEGEQLSNEEFFYWKDTLAHGCHPLDEKLVNSWPEKPATYREVVAKYSVEVRKLTMRMLDYICEGLELKLGYFDNELSQIQMMLTNYYPPCPDPSSTLGSGGHYDGNLITLLQQDLPGLQQLIVKDGNWIAVEPNPTAFVINLGLTLKVITNEKFEGSIHRVVADPTRDRVSIATLIGPDYSCTIEPGKELLSQDNPPLYKPYPYTEFAEIYLSDKSGYMLVLSHIKSNA

SEQ ID NO: 1151 - protein, 323 aa, Glycine max
  misc_feature (1)..(323): Public GI ID no. 356532490
  misc_feature (1)..(323): Bit score of 347.4 for HMM based on sequences of FIGURE 5.
  misc_feature (164)..(271): Pfam Name: 2OG-FeII_Oxy Pfam Description: 2OG-Fe(II) oxygenase superfamily
  misc_feature (1)..(323): Functional Homolog Of SEQ ID NO. 287
MVAPFPISTRSEKILPIDLPVVDLTAERSMVTKLIVKACEEYGFFNVINHGIPRDTIAEMEETAFDFFAKPMAQKKQLALYGCKNIGFNGDMGEVEYLLLSATPPSISHFKNISNMPSKFSSSVSAYTEGVRELACEILELMAEGLGVPDTWFFSRLIREVDSDSVLRFNHYPPIILNNKDCKDNHNHTKVIGFGEHSDPQILTILRSNDVGGLQISLQDGVWNPVAPDPSAFCVNVGDLLQVMTNGRFVSVRHRAMTNSHKSRMSVAYFGGPPLDACIVAPPVMVTPERPSLLFKPFTWAEYKKVTYSMRLGEHRIDLFRSN

SEQ ID NO: 1152 - protein, 327 aa, Glycine max
  misc_feature (1)..(327): Public GI ID no. 356533324
  misc_feature (1)..(327): Bit score of 489.1 for HMM based on sequences of FIGURE 5.
  misc_feature (40)..(53): Pfam Name: 2OG-FeII_Oxy Pfam Description: 2OG-Fe(II) oxygenase superfamily
  misc_feature (1)..(327): Functional Homolog Of SEQ ID NO. 287
MLNESCLVKTCKPSIMFTRVPEVDLSDPEAKSLIIKASKECGFFKVVQHGVAFELITNLENEVLRFFHQPQPQKDKVVPPDPCGYGSRKIGANGDEGWLEYLLINTNPDDPKSLHLFQQNPANFRSAVEDYIGAVKNLCSDVLELMADGLGVEPRNVFSRLTMDERSDCLLRVNRYPVCAELDEFEALSEQYLIGFGEHTDPQIISVLRSNNSHGLQICLRDGTWASIPPDQTSFFVIVGDLLQVMTNGRFKSVKHRVLTDSTISRISIIYFGGPPLNENIAPLPSLVLKEEESLYKELTWQEYKTATFKSRLSDNRLRLFEKFPSE

SEQ ID NO: 1153 - DNA, 1355 bp, Panicum virgatum
  misc_feature (1)..(1355): Ceres Clone ID no. 1724110
  misc_feature (1)..(1355): Encodes the peptide sequence at SEQ ID NO. 1154
acggctaggcacactaagtgttttctattctacttatacaccaagcaagctacctttaattaaggagatcgagagttggctagcttcctagagagagagagagagagagagagatgcatgatatggagtctctccctgtgcccagcgttcaggcgatggtggcggccaccggtggagcccatgtgccgccaaggtatctccggccagaggtggccgccgatgctgtggctagcgaaggcgaggccgcgatacccatcattgactttgagaggctgctgctggaggaggaggcggcggcggcggcggcggcttcttgtcgcgttgaatctgcacgcctccatgcggcctgccaggagtggggcttcttccagctcataaaccacggagttccggatgacgtcatccaggggatgaaggccaacattgaagcattctttgggttgcctgcagagacgaagcagcagtttgctcaggaacgaggccagctggagggctacggtcagctgttcgtggtgtcggaggatcagaagctggactgggctgacatcctctatctgaatacgcagccgcctgagcaccggaacacgagattctggcctgacaagcccgataccttgaggtcgacactggacgcatattctgctgccgtaaagactgtagcggatcgccttctggctattatgtccagcaacctcgggttgccaccggaggtggttgctagcagatgcagcggtggcggaatgcagtcggtgaggatcaactactatcctccctgcgccgaggcagacaaggttgtgggcttctccccacactcggacgctgatctcctcaccctggtcctgcaagtgaaccaggtccaaggtctgcaggtaaagcgccaagatggtacctgggttcctgtgcggcctctggatggcgcttttgttgtcaacgttggagacattcttcagatcttcacaaatggaaggtaccggagcatagagcaccgtgccgtgatcaacgcggagagcgcgcgcctgtccgttgcagcattccactcaccgaacatccatgccacgattggccctcttctaacagtgacagacggtggaccaccagagcttcatgaggctcttcttctctgccaagctggagggcaagagcttcttgcaacggatgaagctcgatcttgacacagctagcaacagcagcagcacctgagtactgccgcaatttcttcttctctatcgcattgctttgcttgctataaacacatgtcgtcattgcattgggtctgtctctgtagtcaacattacattttatgcacgagatgaacaattaatcaatctgcttaccagataagtgattatttggtg

SEQ ID NO: 1154 - protein, 352 aa, Panicum virgatum
  misc_feature (1)..(352): Ceres Clone ID no. 1724110
  misc_feature (1)..(352): Bit score of 176.2 for HMM based on sequences of FIGURE 5.
  misc_feature (211)..(310): Pfam Name: 2OG-FeII_Oxy Pfam Description: 2OG-Fe(II) oxygenase superfamily
  misc_feature (1)..(352): Functional Homolog Of SEQ ID NO. 287
MHDMESLPVPSVQAMVAATGGAHVPPRYLRPEVAADAVASEGEAAIPIIDFERLLLEEEAAAAAAASCRVESARLHAACQEWGFFQLINHGVPDDVIQGMKANIEAFFGLPAETKQQFAQERGQLEGYGQLFVVSEDQKLDWADILYLNTQPPEHRNTRFWPDKPDTLRSTLDAYSAAVKTVADRLLAIMSSNLGLPPEVVASRCSGGGMQSVRINYYPPCAEADKVVGFSPHSDADLLTLVLQVNQVQGLQVKRQDGTWVPVRPLDGAFVVNVGDILQIFTNGRYRSIEHRAVINAESARLSVAAFHSPNIHATIGPLLTVTDGGPPELHEALLLCQAGGQELLATDEARS

SEQ ID NO: 1155 - protein, 314 aa, Podospora anserina S mat+
  misc_feature (1)..(314): Public GI ID no. 171680612
  misc_feature (1)..(314): Bit score of 98.6 for HMM based on sequences of FIGURE 5.
  misc_feature (156)..(253): Pfam Name: 2OG-FeII_Oxy Pfam Description: 2OG-Fe(II) oxygenase superfamily
  misc_feature (1)..(314): Functional Homolog Of SEQ ID NO. 287
MYITHHGIPLSLFQIARNASLDWFRSPLEAKLPANTNNSLKNKGVVGYRPRQTQHINPWESVDVRESFSWRYDPAYDPLHSPSDLENIPDEVKRYIDHDNDGFPWSRTPKEFSGPVIELYQAVLKLGRELVRVMALALGLEEDGLDGRFEFPDVGVAVNYYPPIAATKEEGKEKVSIGSHTDFQLFTLLYQDSVGGLQVLDREGQWLNARPVEGTLVVNFGDYMQRITNGKWVSTVHRVVNNSGRERLSMAFFWGFGLHERCGVLDSVLEEGEEKKYDEIGCWEWVQRRIEMMREVKKGLGNITPEKPLSMHSQ

SEQ ID NO: 1156 - protein, 353 aa, Trichoderma virens Gv29-8
  misc_feature (1)..(353): Public GI ID no. 358380091
  misc_feature (1)..(353): Bit score of 56.0 for HMM based on sequences of FIGURE 5.
  misc_feature (197)..(290): Pfam Name: 2OG-FeII_Oxy Pfam Description: 2OG-Fe(II) oxygenase superfamily
  misc_feature (1)..(353): Functional Homolog Of SEQ ID NO. 287
MAPATSHHLYPPFPDGVVTAPLVSISLAELEADNVAASEDLFKASKELGFFYLKMDGSSLGEKIVLLAEELHALQKKFDDLPFAEKDQFAREKLHPFFGYRHSEIGSIREDGTCDRNELYNMRKDDIIGNCEPLPCPDLIKQHWELLREYVYSCRAVIDLLIVHLERHLQVPSGMIARLHRITERSGDHIRFNKSGIQSYSEEAARRSEHTDFGTLTILFNWLAGLQIRLQDTEDWVYVRPIPGSAVVNLGDALVKFTAGLLRSNIHRVVPPLPPQDGLSRHSLVYFSRPEDSVVLRRLKGGLIDRQPVSETDDLEIRAEEWIVRRSVGDLQGVYTHKGGLEPRTLVVAEGSL

SEQ ID NO: 1157 - protein, 336 aa, Medicago truncatula
  misc_feature (1)..(336): Public GI ID no. 357447293
  misc_feature (1)..(336): Bit score of 584.1 for HMM based on sequences of FIGURE 5.
  misc_feature (53)..(60): Pfam Name: 2OG-FeII_Oxy Pfam Description: 2OG-Fe(II) oxygenase superfamily
  misc_feature (1)..(336): Functional Homolog Of SEQ ID NO. 287
MVVLSKPTLNNFLLVKSCKPSTTLLNGIPVVDLADPEAKTLIVKACKEFGFFKVVNHGVPLEFMSNLENEALRFFKKPQSEKDRAGPPDPFGYGSKRIGSNGDVGWVEYILLNTNPDVISNKSLSFYRENRQNLRSAVEDYIAAMKKMCCLVLELMADGLGIEPKNVLSRLLKDEKSDSCFRINHYPPCPEVQQAALNGRNLLGFGEHTDPQVISVLRSNSTSGLQICLTDGTWVSVPPDHTSFFINVGDTLQVLTNGRFKSVKHRVLADTTKSRLSMIYFGGPPLSEKIVPLPSLMLKKEESLYKEFTWLEYKKAMYNSRLADYRLGPFEKSYGK

SEQ ID NO: 1158 - protein, 354 aa, Oryza sativa Indica Group
  misc_feature (1)..(354): Public GI ID no. 125532930
  misc_feature (1)..(354): Bit score of 172.2 for HMM based on sequences of FIGURE 5.
  misc_feature (206)..(303): Pfam Name: 2OG-FeII_Oxy Pfam Description: 2OG-Fe(II) oxygenase superfamily
  misc_feature (1)..(354): Functional Homolog Of SEQ ID NO. 287
MAGARAIGSLPVPNVQELAKTCNGPDEHIPERYIRPEASSEEVISNYHGEAIPIIDLNKLLSPQSSEECVKLRSACQYWGFFQLINHGVPDEVIANLKRDIVDFFSQPLDAKKEYTQLPNSLEGYGQALVFSEDQKLDWADMLYLQVHPSDSRDLRFWPTSPASFRRSLDAYSSETKSLALCLFEFMAKAVGAKPEALLGIFEEQPQGLRMTYYPPCLQSDKVMGISPHSDVVGLTLLLQVNDVQGLQIKKDGKWLSVDAPNGAFIVNIGDTLEILSNGKFRSVEHRAVINPNKERISASLFHYPCENMVIRPLTEFVKDGKVNYRSISYLDFMTQFFTQQLDGKNRLEMLKLE

SEQ ID NO: 1159 - protein, 358 aa, Brachypodium distachyon
  misc_feature (1)..(358): Public GI ID no. 357127374
  misc_feature (1)..(358): Bit score of 294.6 for HMM based on sequences of FIGURE 5.
  misc_feature (204)..(307): Pfam Name: 2OG-FeII_Oxy Pfam Description: 2OG-Fe(II) oxygenase superfamily
  misc_feature (1)..(358): Functional Homolog Of SEQ ID NO. 287
MVVLAKGELEQIALPAAQSPPANVQAVDLSSARRSGPGRAAAARALVAACEEQGFFKVTGHGVAPALVRALDAAAAAFFALPQAEKEAAAGRPVGYASKRIGTAGDLGWIEYLLLCVAPGAGQALPVPASASFSTLPCAAAAAAAAASLSGSEPESSCPLRGLLEEYAAALRRMACEVLELMAEGLGLAPSDAISRLVSDGGSDNMLRVNHYPPRPELQAGKNQLLTGFGEHTDPQIISVLRSNGTSGLEIASPRDGAWASVPPDADSFFINVGDVLQVLTNGRFRSVKHRVVVNSERPRMSMIFFGGPPPGERLAPLRELLGDDGGRSRYREFTWKEYKSTGCRGRLAEDRLCLFEN

SEQ ID NO: 1160 - protein, 325 aa, Rhodobacteraceae bacterium HTCC2150
  misc_feature (1)..(325): Public GI ID no. 126724682
  misc_feature (1)..(325): Bit score of 73.5 for HMM based on sequences of FIGURE 5.
  misc_feature (154)..(251): Pfam Name: 2OG-FeII_Oxy Pfam Description: 2OG-Fe(II) oxygenase superfamily
  misc_feature (1)..(325): Functional Homolog Of SEQ ID NO. 287
MKLADAIGNAARDFGFFRICDHGIDFDLIEATYQAGAQFFALPDAVKREIYIGNSSNHRGYVPFTEKGDYPDEMNRSYEAFDLGLDLPHDDPDYMMGNRLLGPNVWPEVAGFRDTVARYYSQISKLGRLVCSALEAHLKLPFGAMTNQMSKPISQLRLLHYVRQKSTADHQSVNMGAHTDYECLTLLHTRNKGLQVMTKQDNWIDVPVDPNVFVVNVGDMLEAWSNGILRSTPHRVLNHSPERYSLPYFLAANYDTVIEPFAQLITPDRPVKYEPFTAGSHLERMLIRDFPYLRDTQLQNTASFSVDGVNSTQNPFEQRINQSTI

SEQ ID NO: 1161 - protein, 385 aa, Populus tremula
  misc_feature (1)..(385): Public GI ID no. 53139660
  misc_feature (1)..(385): Bit score of 161.6 for HMM based on sequences of FIGURE 5.
  misc_feature (230)..(328): Pfam Name: 2OG-FeII_Oxy Pfam Description: 2OG-Fe(II) oxygenase superfamily
  misc_feature (1)..(385): Functional Homolog Of SEQ ID NO. 287
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLPLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCDPRIYPDFTWPMLLEFTQKHYRADMKTLEVFTNWLHQRSFS

SEQ ID NO: 1162 - protein, 353 aa, Ajellomyces capsulatus G186AR
  misc_feature (1)..(353): Public GI ID no. 225555204
  misc_feature (1)..(353): Bit score of 72.9 for HMM based on sequences of FIGURE 5.
  misc_feature (195)..(278): Pfam Name: 2OG-FeII_Oxy Pfam Description: 2OG-Fe(II) oxygenase superfamily
  misc_feature (1)..(353): Functional Homolog Of SEQ ID NO. 287
MSQVPVIDSTPLFTSASFSSPECLATISQIHSAFSTWGICILTGTTSVPPSLTNALQTALNRFFSLPSQKKEELHVKNGGWAWRGYMPWGGEGTKGNTDQKEGFYGGPELNPDDGHPLAGMPTYGKNQFPDRDIPEMRKLVLKYIERATELGLTISDAISVGLGLEKEEVRRRILEPEPIQLFRAFKYLKRQGIETCGIGEHSDFGFLTILSQTAAGLQVVSPSGEWVDVPVIPDSFVVNVGDILDRLTSGLYVSPLHRVLPPSPMSDRLSIPFFFDPAWTAEIRPFPLATTGSPDSATLKRWQERSTFNSLQGIWGQYLGVKVQKVFPDLKLPEFPAVSRASTRHLIEVKKI

SEQ ID NO: 1163 - protein, 337 aa, Malus x domestica
  misc_feature (1)..(337): Public GI ID no. 14916565
  misc_feature (1)..(337): Bit score of 154.3 for HMM based on sequences of FIGURE 5.
  misc_feature (160)..(173): Pfam Name: 2OG-FeII_Oxy Pfam Description: 2OG-Fe(II) oxygenase superfamily
  misc_feature (1)..(337): Functional Homolog Of SEQ ID NO. 287
MGVESVERERESNEGTIPAEFIRSENEQPGITTVHGKVLEVPIIDFSDPDEEKLIVQITEASSNWGMYQIVNHDIPSEVISKLQAVGKEFFELPQEEKEAYAKPPDSASIEGYGTKLFKEISEGDTTKKGWVDNLFNKIWPPSVVNYQFWPKNPPSYREANEEYAKHLHNVVEKLFRLLSLGLGLEGQELKKAAGGDNLEYLLKINYYPPCPRPDLALGVVAHTDMSTVTILVPNDVQGLQACKDGRWYDVKYIPNALVIHIGDQMEIMSNGKYTSVLHRTTVNKDKTRISWPVFLEPPADHVVGPHPQLVNAVNQPKYKTKKYGDYVYCKINKLPQ

SEQ ID NO: 1164 - protein, 326 aa, Triticum aestivum
  misc_feature (1)..(326): Public GI ID no. 380851109
  misc_feature (1)..(326): Bit score of 548.6 for HMM based on sequences of FIGURE 5.
  misc_feature (50)..(63): Pfam Name: 2OG-FeII_Oxy Pfam Description: 2OG-Fe(II) oxygenase superfamily
  misc_feature (1)..(326): Functional Homolog Of SEQ ID NO. 287
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVDSASLSGACAVPSCALFRAALNEYIAAVRKVAVRVMEAMAEGLGIAAVDALSGMVTAEGSDQVFRVNHYPPCHALQGLGCSATGFGEHTDPQLISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNRLAQFHR

SEQ ID NO: 1165 - protein, 354 aa, Oryza sativa Japonica Group
  misc_feature (1)..(354): Public GI ID no. 222632219
  misc_feature (1)..(354): Bit score of 459.5 for HMM based on sequences of FIGURE 5.
  misc_feature (177)..(287): Pfam Name: 2OG-FeII_Oxy Pfam Description: 2OG-Fe(II) oxygenase superfamily
  misc_feature (1)..(354): Functional Homolog Of SEQ ID NO. 287
MVVLAKPAALEQISLVRSPSVEDNFGAGLPVVDLAADGAAGEVVRACERFGFFKVVSHGVGEGVVGRLEAEAVRFFASPQAAKDAHGPASPFGYGSKRIGRNGDMGWLEYLLLAIDGASLSRSSPAPSSSLRDAANKYVGAMRGMARTVLEMVAEGLGVAPRGALADMVVGDGAASDQILRLNHYPPCPPLLQNLMPNCSPTGFGEHTDPQLISILHSNSTSGLQVALHHDADAGDHQWVTVPPDPASFLVIVGDSLQVMTNGRMRSVRHRVVANKLKSRVSMIYFGGPPLEQRIAPLRQLLVAGVGNGEEEEQSRYEEFTWGEYKKAAYLSRLSDNRLAPFHRQPPPVANPLA

SEQ ID NO: 1166 - protein, 343 aa, Brachypodium distachyon
  misc_feature (1)..(343): Public GI ID no. 357128141
  misc_feature (1)..(343): Bit score of 343.6 for HMM based on sequences of FIGURE 5.
  misc_feature (45)..(60): Pfam Name: 2OG-FeII_Oxy Pfam Description: 2OG-Fe(II) oxygenase superfamily
  misc_feature (1)..(343): Functional Homolog Of SEQ ID NO. 287
MVMPASTASSAACRDTASGAGIPTVDMSAPWGRAELSRQMVEAFAERGFFKAVNHGVPPRAPATLDAATAAFFERPAPEKQAAGPPDPLGYGSRSIGSHGDVGELEYLTLHADPAAVARRAVAIDREDPSRFSEAVNEYVGAVRRLACQILDLLGEGLGLEDPTALSKIITVSDSDSIIRINHYPPSSAAASSVGFGEHSDPQILSVLRANDVDGLQVLLPDGRGQDTWVQVPADPAAFFINVGDLLQALTNGRLVSIRHRVMASTSKPRLSTIYFAAPALHALISALPETVTSDAPRRYRPFTWAEYKKNMYTLSLSHNRLELYNAVNADAGEARPRSGIAS

SEQ ID NO: 1167 - protein, 329 aa, Glycine max
  misc_feature (1)..(329): Public GI ID no. 356564662
  misc_feature (1)..(329): Bit score of 362.1 for HMM based on sequences of FIGURE 5.
  misc_feature (168)..(274): Pfam Name: 2OG-FeII_Oxy Pfam Description: 2OG-Fe(II) oxygenase superfamily
  misc_feature (1)..(329): Functional Homolog Of SEQ ID NO. 287
MVLASPNSIRSEGILPSNELIPVVDLTAERSQVTKLIVKACEEYGFFKVINHGISHEVISKTEEAGFSFFTKPVAEKKVAAPAYGCKNIGLNGDMGEVEYLLLSATTHSISQISKTISTDPLNVSSTLSAYTEAVRELACEILELIAEGLGVPDTWIFSRFIRDVDSDSVLRLNHYPPIINKDNNKDMSQKFTKVGFGEHSDPQIITILRSNEVGGLQISLQDGVWIPVTPDPSAFYVNVGDVLEVMTNGRFVSVRHRAMTNSYKCRMSVAYFGAPPLHATIVAPSVMVTPQRPSLFRPFTWAEYKKATYSLRLGDTRIQLFTNKLNHS

SEQ ID NO: 1168 - protein, 318 aa, Cucumis sativus
  misc_feature (1)..(318): Public GI ID no. 3779220
  misc_feature (1)..(318): Bit score of 145.6 for HMM based on sequences of FIGURE 5.
  misc_feature (157)..(252): Pfam Name: 2OG-FeII_Oxy Pfam Description: 2OG-Fe(II) oxygenase superfamily
  misc_feature (1)..(318): Functional Homolog Of SEQ ID NO. 287
  misc_feature (125)..(125): Xaa is any aa, unknown, or other
MDFPVINMNNLNGESRVSFLNQINDVCENWGFFELVNHGIPHELMDKVEKMTKEHYRKCMEQRFKEMVASKGLDSVETEINDTDWESTFFLRHLPVSNMSEIGDLDEEYKKVMKEFAAELEKLAXEILNLLCENLGLEKGYLKKVFYGSKGPNFGTKVSNYPPCPKPELIKGLRAHTDAGGLILLFQDDKVSGLQLLKDGKWVDVPPMHHSIVINLGDQLEVITNGKYKSVMHRVIAQEDGNRMSIASFYNPGNDAVIYPAPALVEGEQEKTKLYPKFVFDDYMKLYMGLKFQAKEPRFEAMKAMESTNINMGPIATV

SEQ ID NO: 1169 - protein, 320 aa, Camellia sinensis
  misc_feature (1)..(320): Public GI ID no. 113202132
  misc_feature (1)..(320): Bit score of 135.0 for HMM based on sequences of FIGURE 5.
  misc_feature (157)..(253): Pfam Name: 2OG-FeII_Oxy Pfam Description: 2OG-Fe(II) oxygenase superfamily
  misc_feature (1)..(320): Functional Homolog Of SEQ ID NO. 287
METSQVINMEKLNGEERGATMELIKDACENWGFFELMNHGISHEMMDTVERMTKEHYKKCMEQRFKEVVASKALEGVQAEVTNMDWESTFHLRHLPQSNISEVPDLNDEYRKVMKEFAAKLEKLAEELLDLLCENLGLEKGYLKKAFYGTKGPTFGTKVSNYPPCPKPDLIKGLRAHTDAGGIILLFQDDKVSGLQLLKDGQWIDVPPMRHSIVINLGDQLEVITNGKYKSVLHRVIAQTDGNRMSIASFYNPGNDAVIYPAPALVNEGSDDQTNLVYPKFMFDDYMKLYATVKFQAKEPRFEAMKATEANVNLGPIATA

SEQ ID NO: 1170 - protein, 202 aa, Arabidopsis lyrata subsp. petraea
  misc_feature (1)..(202): Public GI ID no. 50261845
  misc_feature (1)..(202): Bit score of 86.8 for HMM based on sequences of FIGURE 5.
  misc_feature (137)..(201): Pfam Name: 2OG-FeII_Oxy Pfam Description: 2OG-Fe(II) oxygenase superfamily
  misc_feature (1)..(202): Functional Homolog Of SEQ ID NO. 287
MEKIKDACENWGFFECVNHGIPHELLDRVEKMTKEHYKKCMEERFKESIKNRGLDSLHSQVNDVDWESTFYLKHLPVSNLSHVPDLHPDYRTLMKEFAGEIEKLAEELLDLLCENLGLEKGYLKKVFCGSKSPTFGTKVSNYPPCPKPDLVKGLRAHTDAGGIILLFQDDKVSGLQLLKDGDWVDVPPVKHSIVVNLGDQLE

SEQ ID NO: 1171 - protein, 326 aa, Glycine max
  misc_feature (1)..(326): Public GI ID no. 356549549
  misc_feature (1)..(326): Bit score of 575.3 for HMM based on sequences of FIGURE 5.
  misc_feature (173)..(274): Pfam Name: 2OG-FeII_Oxy Pfam Description: 2OG-Fe(II) oxygenase superfamily
  misc_feature (1)..(326): Functional Homolog Of SEQ ID NO. 287
MVLLSKATTEQYSYIKNYMPTAFSSTIPIVDLSKPDAKTLIVKACEEFGFFKVINHGVPIEAISQLESEAFKFFSMPLNEKEKAGPPKPFGYGSKKIGHNGDVGWVEYLLLNTNQEHNFSFYGKNAEKFRCLLNSYMSSVRKMACEILELMAEGLKIQQKNVFSKLLMDKQSDSVFRVNHYPACPELAVNGQNLIGFGEHTDPQIISLLRSNNTSGLQIFLRDGNWISVPPDHKSFFINVGDSLQVMTNGRFRSVRHRVLANGFKSRLSMIYFGGPPLSEKIAPLPSLMKGKESLYKEFTWFEYKNSTYGSRLADNRLGHFERIVA

SEQ ID NO: 1172 - protein, 338 aa, Mycobacterium abscessus ATCC 19977
  misc_feature (1)..(338): Public GI ID no. 169631509
  misc_feature (1)..(338): Bit score of 67.9 for HMM based on sequences of FIGURE 5.
  misc_feature (44)..(58): Pfam Name: 2OG-FeII_Oxy Pfam Description: 2OG-Fe(II) oxygenase superfamily
  misc_feature (1)..(338): Functional Homolog Of SEQ ID NO. 287
MAVKTVAPKRLASNHGRVAELPVIDLSSDSNQLRAALREVAHEVGFFYLTGHGVSPQLVHEVLSAARKLFALSEADKEAIAMVRSPHFRGFTRLGGELTGGLTDWREQIDVGPERAASPTADGRDYMWLQGPNQWPAAVPELRPALESWDIALAEVGRKLLREWAIALGSDGAVFSEAFGDKPATLIKVIRYPSDGTTSQGVGAHRDSGVLTLLLTEPEVGGLQVEVDGAWLEAPGREGAFIVNIGELLERASGGYLRATRHRVTLTGAPRISVAYFFNPRLDARIPVLELPPELRDRARGVSADPDDPIHATYGENAWKSRLRAHPDVAAVHGHLDS

SEQ ID NO: 1173 - protein, 279 aa, Shewanella frigidimarina NCIMB 400
  misc_feature (1)..(279): Public GI ID no. 114562664
  misc_feature (1)..(279): Bit score of 82.3 for HMM based on sequences of FIGURE 5.
  misc_feature (149)..(253): Pfam Name: 2OG-FeII_Oxy Pfam Description: 2OG-Fe(II) oxygenase superfamily
  misc_feature (1)..(279): Functional Homolog Of SEQ ID NO. 287
MKLNTIDYLAPDSAERFVESLRETGFGVLSNHPIQKQLVEDIYKEWYNFFQSEQKHDFLFKSETHDGFFPASISETAKGNNVKDIKEYYHVYPWGRIPDSLRANILAYYEHANTLAAELLSWIEKYTPADVAEKYSIPLPDMIAQSQQTLLRILHYPPMKGDEEMGAIRAAAHEDINLITILPAANEPGLQVKTKTGEWIDVPSDFGSIIINIGDMLQEASGGYFPSTSHRVINPEGTDKTKSRISLPLFLHPNPEVVLSERYTADSYLQERLRELGVI

SEQ ID NO: 1174 - protein, 312 aa, Picea sitchensis
  misc_feature (1)..(312): Public GI ID no. 116783364
  misc_feature (1)..(312): Bit score of 161.9 for HMM based on sequences of FIGURE 5.
  misc_feature (165)..(262): Pfam Name: 2OG-FeII_Oxy Pfam Description: 2OG-Fe(II) oxygenase superfamily
  misc_feature (1)..(312): Functional Homolog Of SEQ ID NO. 287
MSEISHSECIPVVDLKDLDGPNRTTIVGEIRRACEEDGFFQIVNHGVPENVMKSMMGIAKEFYEMPVEDRACFYSEDIKKPVRLSTSFNIGIDKVLNWVDYLTQTCHPLEEVIGTWPEKPAAYRDVAGKYAGEMRALILRLLAAISEALGLDSDYLNKILGKHSQVMNINYYPSCPNPDLTLGAANHSDASAITVLMQSDVSGLQVFKNGKWIAVEPIANALVVNLGDQLQVVSNGRFRSVEHRAVTNIYTARISIPTFYLPGDDAFIAPASSMVDEQQPALYRGYKFEEFLGAFWRQGLKGKSVLDRFMIE

SEQ ID NO: 1175 - protein, 363 aa, Picea sitchensis
  misc_feature (1)..(363): Public GI ID no. 116788048
  misc_feature (1)..(363): Bit score of 159.9 for HMM based on sequences of FIGURE 5.
  misc_feature (30)..(54): Pfam Name: 2OG-FeII_Oxy Pfam Description: 2OG-Fe(II) oxygenase superfamily
  misc_feature (1)..(363): Functional Homolog Of SEQ ID NO. 287
MAMENWAFTRVQTLADSGIQTVPPEYVRRVEKTHHDPNRFQVPIIDLQLGFSSQQHDHFCKDQYDRIAAQISRAAENWGFFQIINHGIPDSLIARVQEASKAFFQLPTKEAYANEAQNPIGYGSKIGYSPDSEAKLEWGDYYYNAIWPPDMRDMSKWPIQLSDFTESMDEYSRELSKLFELLMEVLSRDLDLESENSLNESVGGERKGLHIRINYYPPCPQPDLVVGLAPHSDPNVLTILLHDQTPGLQIRKDGAWIDVQCIPGALVVNIADQMEILSNGKYKSIEHRGVVHKDRSRISWAVFCSPPQDMVVSPKRELIDEQHPPLYQGAPYREYLTKFFKKGLDGKGHIHNAKQQDSLVSNS

SEQ ID NO: 1176 - protein, 360 aa, Oryza sativa Japonica Group
  misc_feature (1)..(360): Public GI ID no. 125575676
  misc_feature (1)..(360): Bit score of 170.4 for HMM based on sequences of FIGURE 5.
  misc_feature (211)..(307): Pfam Name: 2OG-FeII_Oxy Pfam Description: 2OG-Fe(II) oxygenase superfamily
  misc_feature (1)..(360): Functional Homolog Of SEQ ID NO. 287
MVGGFDKLKVEFIDQDESVQVVADTIRSSGEIPERYARPEMEADPVIIDTDGYNLPVIDMSRLINPEFSEEEIAKLGSACEDWGFFQLVNHGVDGELLQRIKDDITEFFRLPLQEKMSVAIPPNGLQGFGHHFVFSKEQKLDWVDLLFLTKRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 1177 - protein, 349 aa, Paracoccidioides brasiliensis Pb03
  misc_feature (1)..(349): Public GI ID no. 225680969
  misc_feature (1)..(349): Bit score of 38.2 for HMM based on sequences of FIGURE 5.
  misc_feature (226)..(308): Pfam Name: 2OG-FeII_Oxy Pfam Description: 2OG-Fe(II) oxygenase superfamily
  misc_feature (1)..(349): Functional Homolog Of SEQ ID NO. 287
MATTFCSLPIVDLTPLKNPNGLRKEEQKSLANQLYDVFVTTGFAYLVNYPLNFDHETLFDITREFFALPIEEKMKLSKRSFCKDNLNTYRGYFPTQPDLANDNLKEGFEIGPKHHGPQSSISNGSTNPGNLKVNLSEPNVWLAPTIFPFRFKLEQLHSELQSLASTLLSLFAIALNKEADFFSPYLTDSLSTLRLLHYPPNANPKLNPSILQQETSPDADSDSDTDATGGLEVQDSDGKWIAAPYVPGSIVVNIGDLMAKVSGGRFVATMHRVRAPPATASSPSPGADDGMQQGLGMGRFSVPFFFEPGEECAVRSVDDDIDGGDGTGALVYGDHVKAKMKTWVEFQGL

SEQ ID NO: 1178 - DNA, 1533 bp, Sorghum bicolor
  misc_feature (1)..(1533): Ceres Annot ID no. 8668753
  misc_feature (1)..(1533): Encodes the peptide sequence at SEQ ID NO. 1179
atggcagttattgatgatccgagtcaccgacctgcccagaaaggataccggatcaagggcagagcggtcccggtgccggcgtggttaacgggagggagggagggactgggagctagggccgggcgccgtgggaaaactgctattggccggcgtgccatcgcctcgtatcgtatgcgtctcccatggagccatgcatgcagcgcggcgggccgacctgccaccggtggatcgcgtccggacacgtcgcgccccggaccccgactgccctggctccatcggcaccgtgcacccaaagcgatcccacccccgatgcatccttttcgtctccctgtcagctgggtcccatccagccaggtgccgcctcgtcccttctcgcttcgctccgggcggggctctccctcgtcaaccgtagtacacaagcacacaccacctcgtctccacctcccctgttctcagcgtgcttgccctgtttcgacctcctctgctcatccgcctccctcgcccgccacgccccaccgtagtacaggccggcagacagccatggtggtgctcgccaacccgcctgtcgtcgaccagatcccgctgctgcggtccccggggcccagggacaccttctcgggcgtgccggtcgtcgacctgtccagccccgccgcggcgcgcgcgatcgtcgacgcctgcgagcgcttcggcttcttcaaggtcgtcaaccacggcgtgcccgcggccaccatgggcagggccgagtccgaggccgtcaggttcttcgcgcaggcgcaggccgacaaggaccgcgccggcccggcgtacccgttcggctacggcagcaagcggatcgggctcaatggcgacatggggtggctcgagtacctcctcctcgccgtcgactccgcgtcgctctccgacgcctgccccgtcccctccaccgccgccttccggagcgcgctgaacgagtacgtcgcggcggtgcggaaggtggcggtgcgcgtgctggaggcgatggcggaaggcctgggcattgcggacgcggccgcgctgagctcgatggtgaccggcgccggcggcgaccaggtgttccgcgtgaaccactacccgccgtgcccggcgctgcagggcctgggctgcagcgccacgggcttcggcgagcacaccgacccgcagctcatctccgtgctccgctccaacggcacgtccggcctgcagatcgcgctccgcgacggcgcgcagtgggtgtccgtgccctccgaccgcgacgccttcttcgttaacgtcggcgactcgttgcaggtgctgacgaacgggaggttcaagagcgtgaagcaccgggtggtgaccaacagcctcaagtctagggtttccttcatctacttcgcgggaccggcgctggagcagcggatcgtgccgctgccggagctgctggcggagggcgaggagagcctgtacaaggagttcacgtggggcgagtacaagaaggccgcgtacaagacgaggctcggggacaacaggctggcccagtttgagaagcgtagcatctag

SEQ ID NO: 1179 - protein, 510 aa, Sorghum bicolor
  misc_feature (1)..(510): Ceres Annot ID no. 8668753
  misc_feature (1)..(510): Bit score of 527.7 for HMM based on sequences of FIGURE 5.
  misc_feature (356)..(459): Pfam Name: 2OG-FeII_Oxy Pfam Description: 2OG-Fe(II) oxygenase superfamily
  misc_feature (1)..(510): Functional Homolog Of SEQ ID NO. 287
MAVIDDPSHRPAQKGYRIKGRAVPVPAWLTGGREGLGARAGRRGKTAIGRRAIASYRMRLPWSHACSAAGRPATGGSRPDTSRPGPRLPWLHRHRAPKAIPPPMHPFRLPVSWVPSSQVPPRPFSLRSGRGSPSSTVVHKHTPPRLHLPCSQRACPVSTSSAHPPPSPATPHRSTGRQTAMVVLANPPVVDQIPLLRSPGPRDTFSGVPVVDLSSPAAARAIVDACERFGFFKVVNHGVPAATMGRAESEAVRFFAQAQADKDRAGPAYPFGYGSKRIGLNGDMGWLEYLLLAVDSASLSDACPVPSTAAFRSALNEYVAAVRKVAVRVLEAMAEGLGIADAAALSSMVTGAGGDQVFRVNHYPPCPALQGLGCSATGFGEHTDPQLISVLRSNGTSGLQIALRDGAQWVSVPSDRDAFFVNVGDSLQVLTNGRFKSVKHRVVTNSLKSRVSFIYFAGPALEQRIVPLPELLAEGEESLYKEFTWGEYKKAAYKTRLGDNRLAQFEKRSI

SEQ ID NO: 1180 - protein, 357 aa, Vitis vinifera
  misc_feature (1)..(357): Public GI ID no. 359473878
  misc_feature (1)..(357): Bit score of 194.8 for HMM based on sequences of FIGURE 5.
  misc_feature (67)..(67): Pfam Name: 2OG-FeII_Oxy Pfam Description: 2OG-Fe(II) oxygenase superfamily
  misc_feature (1)..(357): Functional Homolog Of SEQ ID NO. 287
MALEIEEHPVESLSSGPKLCVKNFVWSEHEWPLINHDDFADGDDIPTISLEGNLSGKPCQDYDKVCQVMVTACEKWGFFKLVDHGVAIETVENVKVQLNELFDLPMDQKLKGARSTSLPLGYCASNPEYGQNLPWAEILQLLQSPQQVVAFARKVFGDQHQPFSNAMVKYMQALDKLGMKIFEMLAHGMGLPDDFFTKNFEEKEATMIRVNRYPPCPLPEKCLGVGSHSDPHTLTILLQDDVGGLQVLKSDNQWIGIRPVPNSFVINIGDTLEAWTNGRLRSVVHRAVVNKEKHRLSVAYFLSPATSAIIDCPPQLIESSTNLRKYVSFTWGEFRKELLTQKRVVGKTALNRYLISP

SEQ ID NO: 1181 - protein, 354 aa, Medicago truncatula
  misc_feature (1)..(354): Public GI ID no. 357488573
  misc_feature (1)..(354): Bit score of 190.0 for HMM based on sequences of FIGURE 5.
  misc_feature (201)..(299): Pfam Name: 2OG-FeII_Oxy Pfam Description: 2OG-Fe(II) oxygenase superfamily
  misc_feature (1)..(354): Functional Homolog Of SEQ ID NO. 287
MSNLGTSLLVPYVQELAKQPNIEVPEQYLQPNQDPINVSNTSSLQQVPVIDLNKLLSEDATELENLDQACKEWGFFQLINHGVDHLLVENVKIGVQEFLSLPVEEKKKLRQTPEDMQGFGQLFVVSENQKLEWADLFYTTTLPSYARNTRLFPNIPQPFRDNLETYCLELQNVCITIIKHMAKALKVEPNEILELFEDGGQQMRMNYYPPCPQPENVIGLNPHSDAGALTILLQANDIEGLQIRKDGQWISVKPLTDAFVINVGDILEIITNGIYRSIEHRATVNSEKERISVAAFHRPQISKVIGPTPTLVTPERPALFKKLTVEDYYKAFFSRKLQGKSCLDIMRIQNENDM

SEQ ID NO: 1182 - protein, 367 aa, Cryptococcus neoformans var. neoformans B-3501A
  misc_feature (1)..(367): Public GI ID no. 58269616
  misc_feature (1)..(367): Bit score of 51.7 for HMM based on sequences of FIGURE 5.
  misc_feature (188)..(294): Pfam Name: 2OG-FeII_Oxy Pfam Description: 2OG-Fe(II) oxygenase superfamily
  misc_feature (1)..(367): Functional Homolog Of SEQ ID NO. 287
MPVPVPQIFQYDYVPETKEDLEWADLATIDLSKFNNPEGRKELAQTLLEAIRTKGFFYVINFGIPQEKVDRQYALGSKFYDLPLEEKSKYVPDLENGEYNGYRPAGRSVLGGGIRDRIEVYNIPKFDGYHERNHPDVIEQNIHEIEEFARSLHTNVLDPLHVLVALALELPEDYFTNLHKYSDPSEDHLRYMMYRHFSPEETKIIESNDGLYTLGHTDLGTLTLLFRQPVAALQIRDHETGNWKWAKPLDGSLTVNTCDALSFLTGGYIKSTVHRVSIPPKDQQQYDRLGLLYFARPQNDLPLATVDSPLLKREGFDKNEFERGGYKVPTMGEFVQVKQKWQQTKRVAHREGDGSQILPGFEGKYHD

SEQ ID NO: 1183 - protein, 352 aa, Yokenella regensburgei ATCC 43003
  misc_feature (1)..(352): Public GI ID no. 365848372
  misc_feature (1)..(352): Bit score of 87.8 for HMM based on sequences of FIGURE 5.
  misc_feature (188)..(283): Pfam Name: 2OG-FeII_Oxy Pfam Description: 2OG-Fe(II) oxygenase superfamily
  misc_feature (1)..(352): Functional Homolog Of SEQ ID NO. 287
MTGIIQRSLEITMRTTSLPILDFSHYHNPAERPAFLQALRHAARDVGFFYLTHHGISEALQQAVSQEARHFFALNDQQKQQVAMIHSPHFRGYNRAASELTRGQPDWREQFDIGAERQAITLTENAPRWQRLQGPNLWPGDLPQLRPVLLEWQQSMTGMAIELLRAFAEALSLPVNTFDALYGEKPNEHIKLIRYPGQQESRQGVGAHKDSGFLSFLLQDEQKGLQVEVSEGEWIDAAPLAGSFVVNIGELLELATNGYLRATVHRVVSPPAGQERLSIAFFLGAQLDAVVPVYQLPEALAREAHGPQSDPQNPLLRDVGWNYLKGRLRSHPDVAERYYRDVLRERTEQLIA

SEQ ID NO: 1184 - protein, 334 aa, Momordica charantia
  misc_feature (1)..(334): Public GI ID no. 217385866
  misc_feature (1)..(334): Bit score of 107.7 for HMM based on sequences of FIGURE 5.
  misc_feature (171)..(268): Pfam Name: 2OG-FeII_Oxy Pfam Description: 2OG-Fe(II) oxygenase superfamily
  misc_feature (1)..(334): Functional Homolog Of SEQ ID NO. 287
MARTGGRIGGGNDSALGGFLKAVTSRPEYNEILVKRPEGFDQCPRAPVELVNHGIAPEFLDTLGRLTKQHYKKCMEQRFQELVSSKGLDAVQAEVDDIDWESTFFFRHLPVSNIADLPELDDEYRRVMKEFAGKLEKLAEELLELLCENLGLEKGYLKNVFYGSKGPTFGTKVSNYPPCPKPDLIKGLRAHTDAGGIILLFQDHKVSGLQLLKDGHWVDVPPLRHSIVVNIGDQLEVITNGKYKSVEHRVIAQADGEGRMSLASFYNPGSDAVIYPAPTLVEKEAEEKNQVYPKFVFEDYMKLYTAVKFQAKEPRFEAMKAVEANVKLGPIATV

SEQ ID NO: 1185 - protein, 370 aa, Fusarium oxysporum Fo5176
  misc_feature (1)..(370): Public GI ID no. 342868843
  misc_feature (1)..(370): Bit score of 85.9 for HMM based on sequences of FIGURE 5.
  misc_feature (218)..(321): Pfam Name: 2OG-FeII_Oxy Pfam Description: 2OG-Fe(II) oxygenase superfamily
  misc_feature (1)..(370): Functional Homolog Of SEQ ID NO. 287
MAQAETTELHLATATGYTTRTILCNPVRKAAASEIPVIDVSAIFSDSLAARQAVAREIHNAARNNGFFYIENHGMSSRVIDQAYCACLSFFRQDMNIKNRTDANNPESFNNGYRAPDTQRINANEGIDLLESYAVGYDPRIGPSITNPSNIPAQAAQHYAPGGHPWEHTGNVPYFKNAITSYFQECLKLARSLTRVFALSLNLAEDFFDDKVKYPEASFELNYYPTLEVDSQMQGSEDASVRLSIGSHTDWQLFTILWQDKVGGLQVLTKNGQWIHAPPLDGTLVVNVADYLQRMTNDKYVSAVHRARNISGRERVSIPFFWGFGLSESCGVLDSCLEEGEERKYEEIKCLDWLNLRTSYMLDIGRDRKI

SEQ ID NO: 1186 - protein, 349 aa, Aspergillus niger ATCC 1015
  misc_feature (1)..(349): Public GI ID no. 350637890
  misc_feature (1)..(349): Bit score of 51.3 for HMM based on sequences of FIGURE 5.
  misc_feature (197)..(286): Pfam Name: 2OG-FeII_Oxy Pfam Description: 2OG-Fe(II) oxygenase superfamily
  misc_feature (1)..(349): Functional Homolog Of SEQ ID NO. 287
MSETNNLPPFPSDIPTAPLLRLSLSKLQAHDITETHNLLQACKDIGFFYLDLRDSNEGTNLLNNADKLFPIGERLFDLPLDEKKKYDLASQKSYYGYKAPGAMVADRQGNLDGNEFYNVSKDDILNIAPSLPSPPILQESRPLLESFVRTSHDIVTLLLSILSDSLSLPTSTLPDLHRLTAPSGDQIRFIKAPPTATQNPTLGEHTDFGSVTILFNRIGGLQVLPPGADAEWTYVRPLSGHAIINLGDAMVKFTNGLFRSNIHRVVAPPGQQAGCTRYSLVYFARPEDEVPLRRLESDRIPALGEGVVEEEISSKDWVIRRALGRRVDLGPVDYEKAAGTEGVSRRLRV

SEQ ID NO: 1187 - protein, 375 aa, Aspergillus nidulans FGSC A4
  misc_feature (1)..(375): Public GI ID no. 259487966
  misc_feature (1)..(375): Bit score of 41.2 for HMM based on sequences of FIGURE 5.
  misc_feature (182)..(288): Pfam Name: 2OG-FeII_Oxy Pfam Description: 2OG-Fe(II) oxygenase superfamily
  misc_feature (1)..(375): Functional Homolog Of SEQ ID NO. 287
MAKMTNQSDSFTVIPVLDYSLSMSSKSAFLADLRYALVNVGFFYLVNAPIKPQIRQDLVKKCRAIFDLPLEKKLEIEMVNSKHFLGYSRLGAEITARKQDYREQFDFATELPAPAPDEPLYRNIRGPNQWPDENAIPGFRQSVEAYLAELSPVAENFQVLIAEALDLPPNALKQFFDKPVQQKMKLIKYPPPPSDAESQGVGPHKDSEFLTFLLQATPHHGLEVQNKSGVWISAPPIEGSLVVNIGRALEAITGGVCTATTHRVSLAPSNYVDAEGTPLGPRFSIPVFQGMSLDLSAEDISLEFPDHIKMLAGDEKARSDAEATFNKIFRGRTGEGTLIHRIISHQDVGRRWYPELLARALGEYEKQGRGLNSSQ

SEQ ID NO: 1188 - protein, 279 aa, Pseudoalteromonas haloplanktis TAC125
  misc_feature (1)..(279): Public GI ID no. 77360864
  misc_feature (1)..(279): Bit score of 74.5 for HMM based on sequences of FIGURE 5.
  misc_feature (150)..(253): Pfam Name: 2OG-FeII_Oxy Pfam Description: 2OG-Fe(II) oxygenase superfamily
  misc_feature (1)..(279): Functional Homolog Of SEQ ID NO. 287
MQLPTVDYKADNAAAQFVESLRNTGFGVLKNHPIPQSLVESIYKNWQDFFNSEQKQDFLFSKDTQDGYFPPSVSEVAKGCKVKDIKEYFHVYPKGRVPAQLEADIREYYRLANEFAATLLSWVQAEAPADVRAKFSIDLKDMIANSEQTLLRILHYPPMTGDEEPGAIRAAAHGDINLLTVLPASNEPGLQVKNTEGGWLDVPSDFGCLIINIGDMLQEASGGYFPSTIHRVINPTGKASSKSRISLPLFLHPRPDVVLSERYTADSYLQERLRELGVK

SEQ ID NO: 1189 - protein, 337 aa, Pyrus communis
  misc_feature (1)..(337): Public GI ID no. 350285025
  misc_feature (1)..(337): Bit score of 606.6 for HMM based on sequences of FIGURE 5.
  misc_feature (178)..(283): Pfam Name: 2OG-FeII_Oxy Pfam Description: 2OG-Fe(II) oxygenase superfamily
  misc_feature (1)..(337): Functional Homolog Of SEQ ID NO. 287
MVFVTKSTSEHFSYPRTSTKVSKLFSGIPLVDLTKPDSKQLIVNACEEYGFFKIINHGVPMDFITRLESEAIKFFSLPLSEKEKSGPPNPLGYGNKHIGKNGDVGWVEYLLLTTNTESISQRFLSVLGNNADEFCSALNDYISAVKKMTCEILELMSDGLKIQPRNVFSKLLMDEQSDSCFRLNHYPPCPELQGLSSASARNVIGFGEHTDPQIISVLRSNNTSGLQISLRDGSWISVPPDQNSFFINVGDSLQVLTNGRFESVRHRVLANGLKSRVSMIYFGGPPLSEKIAPLQSVMNAEEESMYKEFTWFEYKKSAYSSRLADNRLGHFERIAAA

SEQ ID NO: 1190 - DNA, 1071 bp, Arabidopsis thaliana
  misc_feature (1)..(1071): Ceres Annot ID no. 550021
  misc_feature (1)..(1071): Encodes the peptide sequence at SEQ ID NO. 1191
atggaggcggaaggagaaaaacagtggagttctctcatagtaccttttgttctagagatagtgaaagagaagaacttcacaactattcctccgaggtatgttcgggttgatcaagaaaaaactgagatcttaaatgattctagtcttagttctgagattccagtcatcgacatgacacggttgtgttctgtttccgccatggattccgagctcaagaagctggatttcgcttgccaagattggggattttttcaattggtaaaccatggaatagactcgtctttcttggaaaaactagagacagaagttcaagaattcttcaatctccctatgaaagagaagcagaagttgtggcagagaagtggtgaatttgaaggatttggacaagtgaacattgtctcggagaatcagaaactcgattggggagacatgtttatcctcaccactgaaccaattcgatcacgtaaatctcacttgttctccaaattacctcctcctttcagagaaactttagagacttactcctctgaagtgaagagcatagctaagattctgtttgcgaaaatggcgagtgttctagagatcaaacacgaagaaatggaagatttgtttgatgatgtttggcaatctatcaagattaattactacccgccatgtccacagccagatcaagttatgggtttgactcaacattcagacgctgcaggtctcacaatactcttacaggtgaatcaagtggaaggacttcagatcaagaaagacggcaagtgggttgtcgtaaaacctcttcgagatgctttagttgttaatgttggcgaaatcttagagatcataacaaacgggagatatcgaagcatcgagcatagagcggtggtgaattcagagaaagagaggttatcggttgcgatgtttcatagtcccggaaaggagacaatcattcgtcctgcgaaaagccttgtagataggcagaagcaatgtttgttcaaaagtatgagcacacaagagtactttgatgccttctttactcaaaaactcaatgggaaatctcaccttgatcttatgcgtatttaa

SEQ ID NO: 1191 - protein, 356 aa, Arabidopsis thaliana
  misc_feature (1)..(356): Ceres Annot ID no. 550021
  misc_feature (1)..(356): Bit score of 182.1 for HMM based on sequences of FIGURE 5.
  misc_feature (208)..(307): Pfam Name: 2OG-FeII_Oxy Pfam Description: 2OG-Fe(II) oxygenase superfamily
  misc_feature (1)..(356): Functional Homolog Of SEQ ID NO. 287
MEAEGEKQWSSLIVPFVLEIVKEKNFTTIPPRYVRVDQEKTEILNDSSLSSEIPVIDMTRLCSVSAMDSELKKLDFACQDWGFFQLVNHGIDSSFLEKLETEVQEFFNLPMKEKQKLWQRSGEFEGFGQVNIVSENQKLDWGDMFILTTEPIRSRKSHLFSKLPPPFRETLETYSSEVKSIAKILFAKMASVLEIKHEEMEDLFDDVWQSIKINYYPPCPQPDQVMGLTQHSDAAGLTILLQVNQVEGLQIKKDGKWVVVKPLRDALVVNVGEILEIITNGRYRSIEHRAVVNSEKERLSVAMFHSPGKETIIRPAKSLVDRQKQCLFKSMSTQEYFDAFFTQKLNGKSHLDLMRI

SEQ ID NO: 1192 - protein, 302 aa, Rhodobacteraceae bacterium HTCC2150
  misc_feature (1)..(302): Public GI ID no. 126726302
  misc_feature (1)..(302): Bit score of 70.6 for HMM based on sequences of FIGURE 5.
  misc_feature (169)..(266): Pfam Name: 2OG-FeII_Oxy Pfam Description: 2OG-Fe(II) oxygenase superfamily
  misc_feature (1)..(302): Functional Homolog Of SEQ ID NO. 287
MIPEIDTKALIAGDPEVLAMVRAAAEGIGFMTIVNTPFSSERMQTLLQAYHRFFRQPETAKQSINMAATGSNRGWGAAGSEQVDPNANPDYKQVFDCGFELKIADANAPTEFYAPNLWPADMAGFRVLVETYYEDACAFAFELLRSIAIAIGEPAEFFDDKFDRPMALLRGNYYPTRPEWAGENDFGIATHTDYGCLTLLATDGSPGLEVRKRGGGWIPVSATPGDFVINFGEMLEMWTTDRVKATPHRVVGTNAERISIPLFFNPNFDTNVAPVGSDDVILAGDHISKRFNETYVHLNKDD

SEQ ID NO: 1193 - protein, 354 aa, Gordonia otitidis NBRC 100426
  misc_feature (1)..(354): Public GI ID no. 377560209
  misc_feature (1)..(354): Bit score of 75.9 for HMM based on sequences of FIGURE 5.
  misc_feature (187)..(291): Pfam Name: 2OG-FeII_Oxy Pfam Description: 2OG-Fe(II) oxygenase superfamily
  misc_feature (1)..(354): Functional Homolog Of SEQ ID NO. 287
MSTTQADSTAFEVPVIDISPYTGNGTAEDRARVADEMDRACSTVGFVQVLGHAVPDDVWRGLGEAVDDFFGQSLEEKKTYVAQGNRGYSPPKSESLSLSLGIEAASRMNDFFEAFNVGTEARSFAGLDLSEDDYGINVWPDLDGFRPKVEEYYAHAARVARVLTSVFADALSLPSDFFEYLTDHSVDVLRMNNYALPEGTVTLDGDLTGMGEHTDFGLVTVLWADQVAGLQVLGRDGVWHDVSPIDGALLINLGDLTARLTNDRWMSTLHRVKPPIVNGTIQRRRSVAFFHDGNIDATIETLPSHLESDNGLAYEPITVREHIAAKLAGSRQGKANTSAVREAARVRSAAEAAR

SEQ ID NO: 1194 - protein, 333 aa, Glycine max
  misc_feature (1)..(333): Public GI ID no. 356549099
  misc_feature (1)..(333): Bit score of 594.5 for HMM based on sequences of FIGURE 5.
  misc_feature (177)..(278): Pfam Name: 2OG-FeII_Oxy Pfam Description: 2OG-Fe(II) oxygenase superfamily
  misc_feature (1)..(333): Functional Homolog Of SEQ ID NO. 287
MVVLSQPALNQFFLLKTCKPTPLFSGIPVVDLTDPDAKTHIVKACRDFGFFKLVNHGVPLEFMANLENETLRFFKKPQSDKDRAGPPDPFGYGSKRIGPNGDVGWVEYLLLNTNPDVISPKSQFIFRESPQNFRVVVEEYIRALKNMCYEVLELMAEGLGITQRNALSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGAPLSEKISPLPSLMLKGEESFYKEFTWWEYKKAAYASRLADNRLAPFEKSAAD

SEQ ID NO: 1195 - protein, 284 aa, Oryza sativa Japonica Group
  misc_feature (1)..(284): Public GI ID no. 125569479
  misc_feature (1)..(284): Bit score of 291.6 for HMM based on sequences of FIGURE 5.
  misc_feature (129)..(234): Pfam Name: 2OG-FeII_Oxy Pfam Description: 2OG-Fe(II) oxygenase superfamily
  misc_feature (1)..(284): Functional Homolog Of SEQ ID NO. 287
MVVLAKGELEQIALPAAHPPPADVRAIDLSATGPARAAEARALVAACEEQGFFRVTGHGVPAGAVAFCVNRDRWFSLVCLFCSRCRELLREYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDGGRSRYREFTWKEYKGSGCKGRLADDRLCRFEN

SEQ ID NO: 1196 - protein, 362 aa, Magnaporthe oryzae 70-15
  misc_feature (1)..(362): Public GI ID no. 145607820
  misc_feature (1)..(362): Bit score of 57.7 for HMM based on sequences of FIGURE 5.
  misc_feature (187)..(282): Pfam Name: 2OG-FeII_Oxy Pfam Description: 2OG-Fe(II) oxygenase superfamily
  misc_feature (1)..(362): Functional Homolog Of SEQ ID NO. 287
MPSAVPKSYQYTHVPETKEDLDWADLPTVDLAKYGTPEGNAELAQTLIDAIRSKGFFYVVNYGISQDAVDRQFALGQSFYKLPLEEKLKYVPDLENGVYNGYRPAGRRIMGNGQPDKVEVWNMATNDGHITQPVPQLVQESLPEIESFAKDLHDKVLDPLNHLIALALELPPDFFTKLHRWDVHDESHLRYMNYGKYSPEEVERLAGGHWADGHTDLGTITLLFRQPVAALQIKDHGTGQWKWAKPLDGSLTVNTCDALSFLTGGYIKSTVHRVTLPPKDQRHVDRLGLLYFARPQNDLVLKTVDSPVLKREGFTQNEFEAGGHRVPTMGEFTTIKQKWQQSKGYQRKDQVLLPGFTGKIIA

SEQ ID NO: 1197 - protein, 358 aa, Candida tenuis ATCC 10573
  misc_feature (1)..(358): Public GI ID no. 344231610
  misc_feature (1)..(358): Bit score of 67.6 for HMM based on sequences of FIGURE 5.
  misc_feature (212)..(305): Pfam Name: 2OG-FeII_Oxy Pfam Description: 2OG-Fe(II) oxygenase superfamily
  misc_feature (1)..(358): Functional Homolog Of SEQ ID NO. 287
METEETAQTTEFVSFSGNVRSVINDSVRKSDVSDIPIISLSQPRHQVVQQIRDACTRIGFFYITDHEVPQQYIDKLLSAAEKFFHAPGHVREEIHFSKSKHFRGYERCGDNNTETGKNPDLNEQFSWGYDATLDPIKPSIGFDNNSKQDKNIMIGDNVWPTQVPELKPAVKDYYGSVLMLARKLIKLFALALSLPETYFDPMFMSPGAMGRILHYFPQNPAVEDTLGLGAHTDIECFTILYQGNVPALQVLNSSGEWIEATPVENTFVINIGDMLARWSNDVFISTVHRVLNVTGKERYSIPVFVGTEYSTIIEPLATCVGPEGPKYKPIKAGDYVYKRLAFSRLGREEYEQKIKELG

SEQ ID NO: 1198 - protein, 322 aa, Populus trichocarpa
  misc_feature (1)..(322): Public GI ID no. 224130932
  misc_feature (1)..(322): Bit score of 418.3 for HMM based on sequences of FIGURE 5.
  misc_feature (170)..(273): Pfam Name: 2OG-FeII_Oxy Pfam Description: 2OG-Fe(II) oxygenase superfamily
  misc_feature (1)..(322): Functional Homolog Of SEQ ID NO. 287
MVVPSPTPIRTKTTKALGIPTVDLSLDNSSVSQLIVRACEEYGFFKVINHGVNKEVVTRLEEEAARFFGKPAAEKQQAGPASPFGYGCKNIGCHGDTGELEYLLLHTNLLSVSERSKTISNDPSGFSCAVSDYIRAVRQLACEILDLAAEGLWVPDKHVFSRLIRDVHSDSVLRLNHYPAVEEIADWDPSPIRIGFGEHSDPQILTILRSNDVAGLQICLHDGLWVPVPPDSTGFYVIVGDSFQVLTNGRFESVRHRVLTNSSQPRMSMMYFGAPPLTAWIAPLSHMVSQQNPSLYKPFTWSEFKKAAYSLRLRDTRLDLFK

SEQ ID NO: 1199 - protein, 355 aa, Metarhizium acridum CQMa 102
  misc_feature (1)..(355): Public GI ID no. 322693186
  misc_feature (1)..(355): Bit score of 79.3 for HMM based on sequences of FIGURE 5.
  misc_feature (206)..(315): Pfam Name: 2OG-FeII_Oxy Pfam Description: 2OG-Fe(II) oxygenase superfamily
  misc_feature (1)..(355): Functional Homolog Of SEQ ID NO. 287
MGDFLPNSRRTVRTLDFADFLHGDSNKQSKFCRELIECLSTVGFVKLVNHGISEKELYEVFEWNKRFFSLPLAAKTKAAHPYGPNPHRGYSYIGQEKLSKVKDYEKGSRNAAEVYDVKVSLLIYLVPLASNVGLTWFLQESFDQGPVHDELYPNRWPDEDDLPNFRAFMEGLYERCHKIHQEILQALALGLGLDPGFFRDICDQNTSEVRLNHYPGCEAAILRKGAKRISEHTDFGTVTLLFQDSVGGLEIEDQDVPGDYFPIPFVNRSEMIVNIGDCLQRWSNDKFRATSHRVVLPPGSGDGWIEDRYSVAYFGKPNRSQVVGALPELLPEGVKSKYSNITAWEYNQEKLTLTY

SEQ ID NO: 1200 - protein, 325 aa, Phalaenopsis hybrid cultivar
  misc_feature (1)..(325): Public GI ID no. 37698286
  misc_feature (1)..(325): Bit score of 128.2 for HMM based on sequences of FIGURE 5.
  misc_feature (161)..(257): Pfam Name: 2OG-FeII_Oxy Pfam Description: 2OG-Fe(II) oxygenase superfamily
  misc_feature (1)..(325): Functional Homolog Of SEQ ID NO. 287
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDGEWIDVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 1201 - DNA, 1008 bp, Populus balsamifera subsp. trichocarpa
  misc_feature (1)..(1008): Ceres Annot ID no. 1517584
  misc_feature (1)..(1008): Encodes the peptide sequence at SEQ ID NO. 1202
atggtagtggcatccccaactcaaattcacggggaaaaactcctggccattgagcttcctgtaatagatctctcaggcgagagatcaatggtgtccagtctcattgtcaaagcctgtgaagaatatggttttttcaaggtaaaaaaccatggcgttcctcatgacatcattgccaaaatggaaaacgaaagtttcaacttctttgccaaaacattcgatgaaaagcaaaaggctgggcttgataattcctttggttatggctgcaaaaacattggctttaatggtgatacaggagaggttgaatatctgctttgtaataccaatcctctctccattgctgaaagatccaaaaccatctccaatgaccctacagaattcagctctgcaatgagcggctacatagaagcagttagggagctggcatgtgagttattagatctgatggcagagggattgtgggtcccagatagatcagtgttcagtcgactaatcagagatgatgacagtgactcaatcatcaggttaaatcactaccctgccatgcctatactctgcaaggataaggactcctcatcaccttgtaaccacaacaaggtaggatttggagagcattctgaccctcagatcttgaccatcttaagatccaacgacgtgggtggccttcagatttccctgaatgatggtgcctgggttccagtaacacctgaccccactgccttctgtgttaatgtgggtgacttgttacaggcaatgacaaatgggagatttgtaagtgtgaggcacaaagccctaaccaactcatacaagtctagaatgtcaatggcctattttgctgcacccccacttaatgcaaggatcgctgttccaccagaaatggttacacccatcaagcctgccttatacaggcctttctcctgggctgaattcaagaatgctgcttttgctctgcgacttggagatagccgccttggtctattcatgctggaagtagatgaccaagttgcttga

SEQ ID NO: 1202 - protein, 335 aa, Populus balsamifera subsp. trichocarpa
  misc_feature (1)..(335): Ceres Annot ID no. 1517584
  misc_feature (1)..(335): Bit score of 380.5 for HMM based on sequences of FIGURE 5.
  misc_feature (170)..(280): Pfam Name: 2OG-FeII_Oxy Pfam Description: 2OG-Fe(II) oxygenase superfamily
  misc_feature (1)..(335): Functional Homolog Of SEQ ID NO. 287
MVVASPTQIHGEKLLAIELPVIDLSGERSMVSSLIVKACEEYGFFKVKNHGVPHDIIAKMENESFNFFAKTFDEKQKAGLDNSFGYGCKNIGFNGDTGEVEYLLCNTNPLSIAERSKTISNDPTEFSSAMSGYIEAVRELACELLDLMAEGLWVPDRSVFSRLIRDDDSDSIIRLNHYPAMPILCKDKDSSSPCNHNKVGFGEHSDPQILTILRSNDVGGLQISLNDGAWVPVTPDPTAFCVNVGDLLQAMTNGRFVSVRHKALTNSYKSRMSMAYFAAPPLNARIAVPPEMVTPIKPALYRPFSWAEFKNAAFALRLGDSRLGLFMLEVDDQVA

SEQ ID NO: 1203 - DNA, 1074 bp, Sorghum bicolor
  misc_feature (1)..(1074): Ceres Annot ID no. 8670458
  misc_feature (1)..(1074): Encodes the peptide sequence at SEQ ID NO. 1204
atggctgccgctgagaatgagatcaagataggtcaggtcgacgacgtccaggagctgcaccgaacgggcctgacgacggtgcccgatcggtacatcagagacggcgacgaccggccagacggcgacaacgtctgtgccctcgcgcacatcccggtgatcgacgtcggcgacctcccgcgcggcgacgacgagctggacaagctcaggctcgcctgcgaggagtggggtttcttccaggttgtcaaccatggcatcgcgcacgagctgctggacgagatggagaagctgacgagggagttcttcatgctgccgctggaggagaaggagaagtaccccatggcgccgggcgggatccaggggtacggccacgcgttcgtcttctcggaggaccagaagctggactggtgcaacatgctggcgctgggcgtggagccggcgtccatccggcagccgaagctgtggccgacggcgccggcaaggttcagggagaccctggaggcgtactccgcggaggtcaggaagctctgccggactctgcttgcgcacatcgccgagacgctgggcctggcgccggccacgttcggcgacatgttcggcgaggcggtgcaggcggtgcggatgaacttctacccgccgtgcccgcggccggagctcgtcatggggctcagcgcgcactcggacggcagcgcggtcaccgtgctccagcaggacatgagctgcgccggcctgcaggtgcgcagcaaggccggcgcctgggtgcccgtccaccccgtccagcacgcactcgtcgtcaacctcggcgacacccttgaggttctgacgaacggcaggtacaagagcgtggagcacagagcggtggtgaacggcgagcaggaccggctgtcggtggtgacgttctacgcgccggcctacgacgtcgagctcggaccactgccggagttcgtcaccgacgaggcgccgtgccggtaccggaggttcaaccacggcgagtacagccgccattacgtcaccagcaggctcgagggcaagaagacgctcgagttcgccatggttaatccgccggtcggccggtga

SEQ ID NO: 1204 - protein, 357 aa, Sorghum bicolor
  misc_feature (1)..(357): Ceres Annot ID no. 8670458
  misc_feature (1)..(357): Bit score of 193.4 for HMM based on sequences of FIGURE 5.
  misc_feature (204)..(302): Pfam Name: 2OG-FeII_Oxy Pfam Description: 2OG-Fe(II) oxygenase superfamily
  misc_feature (1)..(357): Functional Homolog Of SEQ ID NO. 287
MAAAENEIKIGQVDDVQELHRTGLTTVPDRYIRDGDDRPDGDNVCALAHIPVIDVGDLPRGDDELDKLRLACEEWGFFQVVNHGIAHELLDEMEKLTREFFMLPLEEKEKYPMAPGGIQGYGHAFVFSEDQKLDWCNMLALGVEPASIRQPKLWPTAPARFRETLEAYSAEVRKLCRTLLAHIAETLGLAPATFGDMFGEAVQAVRMNFYPPCPRPELVMGLSAHSDGSAVTVLQQDMSCAGLQVRSKAGAWVPVHPVQHALVVNLGDTLEVLTNGRYKSVEHRAVVNGEQDRLSVVTFYAPAYDVELGPLPEFVTDEAPCRYRRFNHGEYSRHYVTSRLEGKKTLEFAMVNPPVGR

SEQ ID NO: 1205 - protein, 322 aa, Medicago truncatula
  misc_feature (1)..(322): Public GI ID no. 357448799
  misc_feature (1)..(322): Bit score of 351.5 for HMM based on sequences of FIGURE 5.
  misc_feature (163)..(266): Pfam Name: 2OG-FeII_Oxy Pfam Description: 2OG-Fe(II) oxygenase superfamily
  misc_feature (1)..(322): Functional Homolog Of SEQ ID NO. 287
MVVASPNSILGERIIPIDLPMIDLSAEKSMVIKLIVKACEEYGFFNVINHGVPHDIISKMEEVGFDFFAKPMEQKKLVALGNPFGYGCKNIGFNGDMGEVEYLLLNANAPSIPNDSSNFSSSVSAYTEAVKELACEILELMAEGLGVPDTSIFSTFITQLDNDSLLRFNHYPPKDCKDRDNSNSYNVGFGEHSDPQILTILRSNDVAGLQISLQHGVWNPVTPDPAAFCVNVGDLLEVMTNGRFVSVRHRAVTNSYKSRMSVAYFGAPPLDACIVAPSVMVTPNRPSLLFKPFTWAEYKKVTYSLRLGDSRIDLFKNCTQIE

SEQ ID NO: 1206 - protein, 348 aa, Botryotinia fuckeliana B05.10
  misc_feature (1)..(348): Public GI ID no. 154296822
  misc_feature (1)..(348): Bit score of 42.8 for HMM based on sequences of FIGURE 5.
  misc_feature (165)..(272): Pfam Name: 2OG-FeII_Oxy Pfam Description: 2OG-Fe(II) oxygenase superfamily
  misc_feature (1)..(348): Functional Homolog Of SEQ ID NO. 287
MPTSTYFDKYPPFPSNIPVANVPIFSFLKLAVNDEHESFALFEASRHIGFFQLDFTGCSFGDQFLKNTETMFNLNTELYKPLGYHKIGKIGDRVELYGISRDDITGASEPLANPSCIERCRPQLKTYIEQANEIVNNILGHLEKHLKLPLGTFSQLQPMTEPSGSVLRMLKYEPQPPDDRRTAMMGHTDITTLTLLFSTTGGLQILNDDADPHLESSWTHIKPQPSTCIVNLGDAMVEWTGGILRSAMHRVTSPPGDQSSMTRYVVGYFARPAGDSLMKRLAPPEYPFSLVSPVKEPENSGNDMNARDWEWHKLSSVKAGNMGGSLGGKPFEQKRDLNELFPVVVDAA

SEQ ID NO: 1207 - DNA, 648 bp, Populus balsamifera subsp. trichocarpa
  misc_feature (1)..(648): Ceres Annot ID no. 1458668
  misc_feature (1)..(648): Encodes the peptide sequence at SEQ ID NO. 1208
atggacaagtcagacagatacatctccgctgtgagtgcttacatagaagcagttagggagctggcatgtgagttattagatctgatggcggaggggctgcgggtcccggatagatcagtgtttagtaggctaatcagagatgttgacagtgactccctcatcaggttaaaccactacccccctatgcctctgctctgcaaggatgaggactcgtcaccttgtaaccaaaacaaggtagggttcggagagcattctgaccctcagatcttgaccatcttgagatccaacgatgtgggtggccttcagatttccttaaatgatggtgcgtgggtcccagtaacacctgatcccgctaccttctgggttaatgtgggtgacttgttacaggcaatgacaaatgggagatttgtaagtgtgaggcacaaagccctaaccaactcttccaagtctagaatgtcaatggcctattttgctggccctccacccaatgcgaggatcactgttccaccagaaatgattacccccaccaagccggcattatacaagccctttacctgggctgaattcaagaaagctgcttatgctatgcgacttggagatagacgccttggtctattcaggatggaaggagacgagcaagttgcttga

SEQ ID NO: 1208 - protein, 215 aa, Populus balsamifera subsp. trichocarpa
  misc_feature (1)..(215): Ceres Annot ID no. 1458668
  misc_feature (1)..(215): Bit score of 264.8 for HMM based on sequences of FIGURE 5.
  misc_feature (51)..(160): Pfam Name: 2OG-FeII_Oxy Pfam Description: 2OG-Fe(II) oxygenase superfamily
  misc_feature (1)..(215): Functional Homolog Of SEQ ID NO. 287
MDKSDRYISAVSAYIEAVRELACELLDLMAEGLRVPDRSVFSRLIRDVDSDSLIRLNHYPPMPLLCKDEDSSPCNQNKVGFGEHSDPQILTILRSNDVGGLQISLNDGAWVPVTPDPATFWVNVGDLLQAMTNGRFVSVRHKALTNSSKSRMSMAYFAGPPPNARITVPPEMITPTKPALYKPFTWAEFKKAAYAMRLGDRRLGLFRMEGDEQVA

SEQ ID NO: 1209 - protein, 364 aa, Brachypodium distachyon
  misc_feature (1)..(364): Public GI ID no. 357117693
  misc_feature (1)..(364): Bit score of 168.7 for HMM based on sequences of FIGURE 5.
  misc_feature (217)..(314): Pfam Name: 2OG-FeII_Oxy Pfam Description: 2OG-Fe(II) oxygenase superfamily
  misc_feature (1)..(364): Functional Homolog Of SEQ ID NO. 287
MESPLTGSESRWLHVTKSPIPVRNVQDLVASSDELTAETMERYIRQDIDRDVVLAGHSAEIPVIDLAKLLNPDSVAAELAKLRFACEDWGFFQVINHGLPNEVIAAAKHDIEDFFRLPLDAKNDHAQRPGEIQGYGQAFVVSDDQKLDWADMLSLFSQPPQHRDMSYWPKQPHTFRNSIGEYSSELLKFSRYIETFIAKTLNVDYELMGGNCAVQTLRMTYYPPCMSMPNKVLGFSPHSDGSFITILLEVNSVQGLQIRKHDVWVPVKPHPEALLVNVGDLLEIMTNGKYKSVEHRVTINAHKERLSMSAFHLPKFEAIISPIPDIIEGKVLYKTVRVEEYAKLYLSNKLDGKKALDFAKISPT

SEQ ID NO: 1210 - protein, 320 aa, Pelargonium x hortorum
  misc_feature (1)..(320): Public GI ID no. 1527191
  misc_feature (1)..(320): Bit score of 147.4 for HMM based on sequences of FIGURE 5.
  misc_feature (157)..(253): Pfam Name: 2OG-FeII_Oxy Pfam Description: 2OG-Fe(II) oxygenase superfamily
  misc_feature (1)..(320): Functional Homolog Of SEQ ID NO. 287
MEKFPVINLEKLNGEGRAETMDKIKDACENWGFFEVLNHGIPYELLDTVEKMTKEHYKKCMEQRFKEMVTSKGLDGVEAEVEDMDWESTFFLKHLPESNISQVPDLQDNYRKVMKEFALKLENLAEELLDLLCENLGLEKGYLKKAFYGSKGPTFGTKVSNYPPCPKPDLIKGLRAHTDAGGLILLFQDDKVSGLQLLKDGNWVDVPPMHHSIVINLGDQLEVITNGKYKSVEHRVIAQSDGTRMSIASFYNPGSDAVIYPAPALLAKETEEKQVYPKFVFEDYMKLYSGLKFKAKEPRFEVMKAREDNINVTLDPIATS

SEQ ID NO: 1211 - protein, 366 aa, Oryza sativa Japonica Group
  misc_feature (1)..(366): Public GI ID no. 115442079
  misc_feature (1)..(366): Bit score of 186.2 for HMM based on sequences of FIGURE 5.
  misc_feature (91)..(104): Pfam Name: 2OG-FeII_Oxy Pfam Description: 2OG-Fe(II) oxygenase superfamily
  misc_feature (1)..(366): Functional Homolog Of SEQ ID NO. 287
MDSGAAAVCAEKASEIIKIGQVDDVQELQRRLCSATTVPERYIRDGDDRPDHAVVDDERAQERIPVIDVGELQRGSEDELDNLRLACEQWGFFQVVNHGVEEETMEEMEKAAREFFMLPLEEKEKYPMEPGGIQGYGHAFVFSDDQKLDWCNMLALGVEPAFIRRPNLWPTTPANFSKTLEKYSVEIRELCVRLLEHIAAALGLAPARLNGMFGEAVQAVRMNFYPPCPRPELVLGLSPHSDGSAVTVLQQDAAFAGLQVLRGGGGWVAVHPVPGALVVNVGDTLEVLTNGRYKSVEHRAVASGEHDRMSVVTFYAPAYDVELGPLPELVADGEPRRYRTYNHGEYSRHYVTSRLQGKKTLEFAKI

SEQ ID NO: 1212 - DNA, 864 bp, Sorghum bicolor
  misc_feature (1)..(864): Ceres Annot ID no. 8725147
  misc_feature (1)..(864): Encodes the peptide sequence at SEQ ID NO. 1213
atgcgcgccggcccgcccagcccgctcggctacggctgccgcaccatcggcttcaacggcgacgccggcgagctcgagtacctgctgctccacgccaaccccgccgccgtcgcgcacagggccaggtccatcgacactgacgacccctcgcgcttcagtaatgtggtgaacgagtatgtgggagcaatgaggcagcttgcatgtgagatcctggacctgttaggagaggggctagggctcaaggaccccagatccttcagcaagctcatcactgacacagacagcgactcactcctgaggatcaaccactaccctccagcatgcaccattcagaagcttgaccatgacaaccaatgcaagatgaagagcagtttcagaatcaagactggcaatggtgtgaaccagtcagcaggtgcacggatcggattcggggagcattcagacccgcagattcttagcttgctccgatcaaacgatgttgacggccttcaggtgcttctgaactgcgacggcagggaggtgtgggttcaggtgccatccgatccatcagcattctttgtcaatgttggtgatctcctccaggctttgacaaatgggaaggtgataagtgtccggcacagggtaattgcaaactcctgcagggcaaggctgtccacaatctacttcgctgcgccgccactgcatgcacgaattttggccctcccagagacaatcacagccaactcaccccgccagtaccggcccttcacctgggccgagtacaagaagacaatgtactccctccgcctgagccacagccgcctcaacctcttccacatcgaccatgatgaccacagcaatgtcggcaaaggagaacaagaatag

SEQ ID NO: 1213 - protein, 287 aa, Sorghum bicolor
  misc_feature (1)..(287): Ceres Annot ID no. 8725147
  misc_feature (1)..(287): Bit score of 284.9 for HMM based on sequences of FIGURE 5.
  misc_feature (96)..(225): Pfam Name: 2OG-FeII_Oxy Pfam Description: 2OG-Fe(II) oxygenase superfamily
  misc_feature (1)..(287): Functional Homolog Of SEQ ID NO. 287
MRAGPPSPLGYGCRTIGFNGDAGELEYLLLHANPAAVAHRARSIDTDDPSRFSNVVNEYVGAMRQLACEILDLLGEGLGLKDPRSFSKLITDTDSDSLLRINHYPPACTIQKLDHDNQCKMKSSFRIKTGNGVNQSAGARIGFGEHSDPQILSLLRSNDVDGLQVLLNCDGREVWVQVPSDPSAFFVNVGDLLQALTNGKVISVRHRVIANSCRARLSTIYFAAPPLHARILALPETITANSPRQYRPFTWAEYKKTMYSLRLSHSRLNLFHIDHDDHSNVGKGEQE

SEQ ID NO: 1214 - protein, 326 aa, Brachypodium distachyon
  misc_feature (1)..(326): Public GI ID no. 357136506
  misc_feature (1)..(326): Bit score of 530.7 for HMM based on sequences of FIGURE 5.
  misc_feature (50)..(62): Pfam Name: 2OG-FeII_Oxy Pfam Description: 2OG-Fe(II) oxygenase superfamily
  misc_feature (1)..(326): Functional Homolog Of SEQ ID NO. 287
MVVLASPPAADHIPLLRSPDPGDYFSGMPVIDLCSPGAPRAIADACERFGFFKLVNHGVATDAMDRLESEAVTFFSQPQADKDRSGPAYPFGYGSKRIGLNGDMGWLEYLLLAVDDSASLSGAVPSGSAFRRALNEYIGAVRKVAVRVMEAMAEGLGIAPLDALSKMVTAAGSDQVFRVNHYPPCAALQGLGCSATGFGEHTDPQLVSVLRSNGTSGLQIALQDGGQWVSVPSDRDALFVNVGDSLQVLTNGRFKSVKHRVVANSLKSRVSLIYFGGPPLTQRIAPLPQLLGEGEQSLYTEFTWSEYKKAAYKSRLGDNRLAQFQK

SEQ ID NO: 1215 - protein, 373 aa, Selaginella moellendorffii
  misc_feature (1)..(373): Public GI ID no. 302759861
  misc_feature (1)..(373): Bit score of 176.9 for HMM based on sequences of FIGURE 5.
  misc_feature (228)..(324): Pfam Name: 2OG-FeII_Oxy Pfam Description: 2OG-Fe(II) oxygenase superfamily
  misc_feature (1)..(373): Functional Homolog Of SEQ ID NO. 287
MNADFLIHQELETPIPIMVEEELTWKEPVQRVQALAEKGLKEVPPSYIRPVSERPFLDKQIHLGDDGSIPVIDFSGLEDHRREDTMDQISRACEEWGFFQLINHCVPVPVMDRTVAAAREFFDLPLEEKQVYANKPWSLVGYGSRIGVTEGAILDWGDYFLHYLWPLDKRDVDQEWPRKPASYVETLDEYTHALHNLCSRLLEALSESLGLRKDYIGEIFGWPDTNLVLRINYYPPCPSPDLTLGVGSHSDGGVITFLLHDNVPGLQVRKGDRWLLLEPIPNAIVVNIADQLQILSNGRFKSVEHRVAVNKDTVRMSLATFCNPDVDTIIAPAEDLVNDDNPVLYRAMTYGEFLESLCRDGLKGKDYVESFRR

SEQ ID NO: 1216 - protein, 364 aa, Physcomitrella patens subsp. patens
  misc_feature (1)..(364): Public GI ID no. 168058603
  misc_feature (1)..(364): Bit score of 151.1 for HMM based on sequences of FIGURE 5.
  misc_feature (215)..(312): Pfam Name: 2OG-FeII_Oxy Pfam Description: 2OG-Fe(II) oxygenase superfamily
  misc_feature (1)..(364): Functional Homolog Of SEQ ID NO. 287
MGQLGNIPSSWNTDSEAFILVSEHRPNLEPNLEADDIPVINLAPFFDHSKDPALRSLVAEIGNACAEWGFFQVVDHKISPELLRKVMEAAKGFFSLPLEEKKKIGRSFDQHLGYNDSELTKNTRDWKEIFDWARLGFMEMPESVDSENRSGRYSNTTLKSYNQWPAKPDGFREACETYTEAVVHLSGLLLGLISVSLGLPFDILHQYFDKDNTIRARLNHYPHCPLANMVCGVNRHIDSGALTVLAQDSVGGLQVKRKDGQWVAVKPREDAFVVNVGAILQVWSNDKYRGVEHRVSVNERKERFSIPVFYDPSIKTDVFPLPQLLDEEHPAQYQSYNWGFFRRTRNNGNFKQLGENIQIHHYRI

SEQ ID NO: 1217 - protein, 472 aa, Glycine max
  misc_feature (1)..(472): Public GI ID no. 356510794
  misc_feature (1)..(472): Bit score of 532.5 for HMM based on sequences of FIGURE 5.
  misc_feature (177)..(281): Pfam Name: 2OG-FeII_Oxy Pfam Description: 2OG-Fe(II) oxygenase superfamily
  misc_feature (1)..(472): Functional Homolog Of SEQ ID NO. 287
MVVHSHQSALNELFLVKASCKSRFMWVPEVDLTHPEAKTVIVKACQEFGLFKVVNYGVPLELMTHLENEALKFFMQSQCQKDKAGPPDPYGYGSKRIGTNGDLGWVEYLLLNTNPDVISPKTLQLFEQNPEVFRCAVEEYIGAVKKMCCEVLELMADGLEIEPRNVFSRMIRDERSDSCFRMNRYPACPELRVEALSGRNLIGFGEHTDPQIISVLRSNNTSGLQMCLRDGTWASIQPDHTSFFVNVGDLLQVMTNGSFKSVKHRVLANSSMSRLSMIYFGGPPLNEKIAPLPSLVSREEESLYRELTWREYKNAAYKSKLSDNRLSLFDKFADHSDKSPLMTLLLGPPSSWKTFLLALAGKLVRDLRIFGLDICADIVVGDEMRRGISGGQKKRVTTGEMLVGPAKALFLDEISTGLDKGQIAYQGSRENVLEFFEHMGFECPERKGVADFLQERPATILVSLIIKRQDLI

SEQ ID NO: 1218 - protein, 321 aa, Ziziphus jujuba
  misc_feature (1)..(321): Public GI ID no. 159149180
  misc_feature (1)..(321): Bit score of 134.3 for HMM based on sequences of FIGURE 5.
  misc_feature (157)..(253): Pfam Name: 2OG-FeII_Oxy Pfam Description: 2OG-Fe(II) oxygenase superfamily
  misc_feature (1)..(321): Functional Homolog Of SEQ ID NO. 287
MENFPVIDMEKLNGEERAATMEKINDACENWGFFELVNHGIAPEFMDTVERQTKEHYRKCMEQRFKEMVESKGLEVVQSEIDDLDWESTFFVRHLPVPNISEIPDLHEGYRKAMKEFAAQIEKLAEQLLDLLCENLGLEKGYLKKAFYGSNGPTFGTKVSNYPPCPKPDLIKGLRAHTDAGGIILLFQDDKVSGLQLLKDGQWIDVPPMRHSIVINLGDQLEVITNGKYKSIMHRVIAQPDGTRMSIASFYNPGSDAVIYPAPALLEKEANDEKKVQVYPKFVFEDYMKLYAGLKFQAKEPRFEAMKTMESTLNLGPIAIV

SEQ ID NO: 1219 - protein, 347 aa, Pseudonocardia dioxanivorans CB1190
  misc_feature (1)..(347): Public GI ID no. 331700025
  misc_feature (1)..(347): Bit score of 36.0 for HMM based on sequences of FIGURE 5.
  misc_feature (192)..(276): Pfam Name: 2OG-FeII_Oxy Pfam Description: 2OG-Fe(II) oxygenase superfamily
  misc_feature (1)..(347): Functional Homolog Of SEQ ID NO. 287
MDIPVLAFDRARRADGSFDPEFLDALRAALHEVGFLQLTDYGAAPGQVEEFAAVVQRFFQLPPEQRLALDNRRSPHFRGYTRLGHEITAGRPDAREQLDYGPELPARPRTEWDAPYRLLEGPNQWPDEALPQLRTVVLAWADLLCRVATDLTRAVAASLGLPEDQFDDAFADTPHWFGKLIRYVGSESDGPDAQGVGPHADWGFLTLLLQDGTGGLQARPPRATEWVDVPPLDGALVVNVGEMLEVATHGYLVSTVHRVLPCAPGTTRQSAGFFWSPRLDATLHAVPLTPELAAHAPGVTETAHNALLPRFGDNALKGWFRSHPEVAERHHPELAADLAVAAGGGAT

SEQ ID NO: 1220 - protein, 324 aa, Cymbidium hybrid cultivar
  misc_feature (1)..(324): Public GI ID no. 117586718
  misc_feature (1)..(324): Bit score of 137.3 for HMM based on sequences of FIGURE 5.
  misc_feature (161)..(257): Pfam Name: 2OG-FeII_Oxy Pfam Description: 2OG-Fe(II) oxygenase superfamily
  misc_feature (1)..(324): Functional Homolog Of SEQ ID NO. 287
MESGSFPVINMELLEGSSRPEAMAVLRDACQNWGFFELLNHGISHELMNRVEAVNKEHYRRFREQRFKEFAAKTLASGEEVDSDNLDWESTFFLRHLPTSNISEVPDLDDDCRSTMKEFAREVEKLAESLLDLLCEDLGLEKGYLKRVFCGGSDGLPTFGTKVSNYPPCPKPELIKGLRAHTDAGGIILLFQDDKVSGLQLLKDGEWVNVPPMRHSIVINIGDQLEVITNGKYKSVLHRVVAQTDGNRMSIASFYNPGSDAVIFPAPALVEREAEEKKIETYPKFVFQDYMNLYVRQKFEAKEPRFEAMKSMESVSSSQLIPTA

SEQ ID NO: 1221 - protein, 322 aa, Dendrobium hybrid cultivar
  misc_feature (1)..(322): Public GI ID no. 41323935
  misc_feature (1)..(322): Bit score of 127.7 for HMM based on sequences of FIGURE 5.
  misc_feature (147)..(243): Pfam Name: 2OG-FeII_Oxy Pfam Description: 2OG-Fe(II) oxygenase superfamily
  misc_feature (1)..(322): Functional Homolog Of SEQ ID NO. 287
MEKLNNYMAVLRDACENWGFFSHFQATLSHELMDKVEHISERYIKKFREQKFKDICSHNSGNFCNTQVNDIDWESTFYLRHRPTSNISKSPEDLDDQYRKLMKEFAAQIERLSEQLLDLLCENLGLEKAYLKNAFYGANGCNPTFGTKVSNYPPCPKPELIKGLRAHTDAGGIILLFQDDTVSGLQLLKDEEWIDVPPMRHSVVVNLGDQLEVITNGKYKSVMHRVIAQTDGNRMSIASFYNPGSDAVIYPAPTLVEKEKETYPKFVFEDYMKLYVRQKFEAKEPRFEAMKTMDAVISSQPIPTAPLPLEAIRGGGYPGDLL

SEQ ID NO: 1222 - protein, 335 aa, Arabidopsis lyrata subsp. lyrata
  misc_feature (1)..(335): Public GI ID no. 297830340
  misc_feature (1)..(335): Bit score of 368.0 for HMM based on sequences of FIGURE 5.
  misc_feature (37)..(66): Pfam Name: 2OG-FeII_Oxy Pfam Description: 2OG-Fe(II) oxygenase superfamily
  misc_feature (1)..(335): Functional Homolog Of SEQ ID NO. 287
MVKESQKIVALDQDIPVIDMSQERLRVSMQIVKACESIGFFKVVNHGVDPDVISRMEQESINFFAKPVLEKKSVGPVVNRPFGYGLKDIGLKGDIGEVEYLLLHTNPLFLSQLSSGNDSTKFGSAVTCYVEAVKQLACEILDLTAEGLRLPPHTFSKLIRAVDSDSVLRFNHYPSSDQFLSGANLSDKSVSLPRVGFGEHTDPQILTVLRSNGVGGLQVAFPDGRWVSVSPDPSVFCVNVGDLLQVMTNGRFLSVRHRAVTTGHASRLSMAYFAGPSVHAKIGPLPTIVTAADQPRLYRTFTWADYKKFAYSLGLGDNRLDIFRSRVDEEDELGF

SEQ ID NO: 1223 - protein, 370 aa, Oryza sativa Japonica Group
  misc_feature (1)..(370): Public GI ID no. 53792534
  misc_feature (1)..(370): Bit score of 340.1 for HMM based on sequences of FIGURE 5.
  misc_feature (59)..(72): Pfam Name: 2OG-FeII_Oxy Pfam Description: 2OG-Fe(II) oxygenase superfamily
  misc_feature (1)..(370): Functional Homolog Of SEQ ID NO. 287
MVVPAAAAPECGRREAAAAAAAAVFCRRGRGVVVPTVDMSAPAGRGELSRQVARACAGSGFFRAVNHGVPPRVSAAMDAAAAAFFVRAGAEKQLAGPPDPLGYGSRSIGANGDVGELEYLILHASPDAVARKASAIDREDPRRFSQVVNDYVEAVRQLACHVLDLLGEGLGLRDPTSLTRLITATDNDSLIRINHYPPSCAAAAGDHKSGGGPAPTAAIGFGEHTDPQILSVLRANDADGLQLLLPDAAAAGDSVWVPVPPDPSAFFVNVGDLLQALTNGRLVSIRHRVVVGTGKPRLSTIYFAAPPLHARISALPETVAAGAPRRYRAFTWAEYKRTMYTLRLSHNRLDLFHAGDGDGDAGVGDDDDHE

SEQ ID NO: 1224 - protein, 314 aa, Pyrus pyrifolia
  misc_feature (1)..(314): Public GI ID no. 54260396
  misc_feature (1)..(314): Bit score of 137.7 for HMM based on sequences of FIGURE 5.
  misc_feature (158)..(253): Pfam Name: 2OG-FeII_Oxy Pfam Description: 2OG-Fe(II) oxygenase superfamily
  misc_feature (1)..(314): Functional Homolog Of SEQ ID NO. 287
MATFPVVDMSLVNGEERAATLEKINDACENWGFFELVNHGISTELLDTVEKMNKDHYKKTMEQRFKEMVVAKGLDAVQSQIHDLDWESTFFLRHLPSSNISEIPDLEEDYRKTMKEFAVELEKLAETLLDLLCENLGLEKGYLKKAFYGSKGPNFGTKVSNYPPCPKPDLIKGLRAHTDAGGIILLFQDDKVSGLQLLKDGEWVDVPPMHHSIVINLGDQIEVITNGKYKSIMHRVIAQSDGTRMSIASFYNPGDDAFISPAPALLEKKSEETPTYPKFLFDDYMKLYSGLKFQAKEPRFEAMKARETSSVATA

SEQ ID NO: 1225 - protein, 354 aa, Brachypodium distachyon
  misc_feature (1)..(354): Public GI ID no. 357128775
  misc_feature (1)..(354): Bit score of 497.0 for HMM based on sequences of FIGURE 5.
  misc_feature (176)..(284): Pfam Name: 2OG-FeII_Oxy Pfam Description: 2OG-Fe(II) oxygenase superfamily
  misc_feature (1)..(354): Functional Homolog Of SEQ ID NO. 287
MVVLAKPAALEQISLLRTPEPWESFAGVPAVDLSAPGAADDVVRACERFGFFSVVNHGVARGVVERLEHEAALFFSWPQADKDASASGPADPFGYGSKRIGRNGDMGWLEYLLLAIDRESLSKASPAPSSSLRDAINEYVGAMRGLARTVLEMVAEGLGVSPRGALADMVTGEASDQVFRLNHYPPCPLLQGLPPNCSVTGFGEHTDPQLVSILHSNATAGLQIALHGDGDAQKWVSVPPNRDAFFVNVGDSLQVLTNGRLKSVRHRVVAGSGRKSRVSMIYFGGPPVAQRIAPLPQLLQAEGQLPIYREFTWGEYKKAAYRSRLGDNRLAPFQMTLVELQHAHADAAGLHHRS

SEQ ID NO: 1226 - protein, 326 aa, Triticum aestivum
  misc_feature (1)..(326): Public GI ID no. 327179115
  misc_feature (1)..(326): Bit score of 546.2 for HMM based on sequences of FIGURE 5.
  misc_feature (50)..(63): Pfam Name: 2OG-FeII_Oxy Pfam Description: 2OG-Fe(II) oxygenase superfamily
  misc_feature (1)..(326): Functional Homolog Of SEQ ID NO. 287
MVVLAGSPAVDHIPLLRSPDPGDNFSGMPVVDLSSPGAPRAIADACERFGFFKLVNHGVPADTMDRLESEAVRFFSLPQADKDRSGPAYPFGYGSKRIGLNGDMGWLEYLLLAVDAASLSAACAVPSCALFRAALNEYIAAVRKVAVRVMEAMAEGLGIAPVDALSAMVTAEGSDQVFRVNHYPPCHALQGLGCSATGFGEHTDPQPISVLRSNGTSGLQIALQNGQWVSVPSDRDAFFVNVGDSLQVLTNGRFKSVKHRVVANSLKSRVSMIYFGGPAMTQRIAPLPQLLGAGEQSLYKDFTWGEYKKAAYNSRLGDNRLAQFHR

SEQ ID NO: 1227 - protein, 373 aa, Trichophyton rubrum CBS 118892
  misc_feature (1)..(373): Public GI ID no. 327306431
  misc_feature (1)..(373): Bit score of 72.7 for HMM based on sequences of FIGURE 5.
  misc_feature (175)..(277): Pfam Name: 2OG-FeII_Oxy Pfam Description: 2OG-Fe(II) oxygenase superfamily
  misc_feature (1)..(373): Functional Homolog Of SEQ ID NO. 287
MSFDSIPILDLSAARDAAKKPGFLNELRHALLEVGFLYIKNTGIDGKLIEDVIVEGKKFFDLPVEKKLEIEMKNAPSFLGYSRLGGEITRFKTDWREQIDLSTNHPVPGPSDPLYHNLLAPNQWPDESSIPRFRPVYEEYMERMGAISMEFISLVAEAIGLPANAFDRFFDKDQQHKLKIVKYPDLEELGVDGEAQGVGPHKDSMLTSYLLQATKHRGLQVQNHRGEWIDCPPIDGTLVVAMGQGLEAITQGVCQSTTHRVLSPARGAGARFSVPFFQGVSYDATFESMDVPEQVKKLRQEVIERNGIRQDDIEFTFSKGRWGHLGEATLMNRIKSHPDVGERFYPALLQQIRDEQARNNQITEAPQGLKVQV

SEQ ID NO: 1228 - protein, 356 aa, Glycine max
  misc_feature (1)..(356): Public GI ID no. 356499745
  misc_feature (1)..(356): Bit score of 402.1 for HMM based on sequences of FIGURE 5.
  misc_feature (172)..(295): Pfam Name: 2OG-FeII_Oxy Pfam Description: 2OG-Fe(II) oxygenase superfamily
  misc_feature (1)..(356): Functional Homolog Of SEQ ID NO. 287
MVAPCPTSMMVRTKKTKAMGVPTIDLSLERSKLAELVVKACEEYGFFKVVNHSVPKEVIARLEEEGKEFFSKTSSEKRQAGPANPFGYGCRNIGPNGDMGHLEYLLLHTNPLSISERSKTIAKDPTKFSCVVNDYIEAAKELTCELLDLVAEGLWVQDKFSLSKLIRDVHSDSLLRINQYPPVSLKGTKNWDTSKVEARQIQSQNNNNNNNNNIGFGEHSDPQILTIMRSNNVDGLQISTHDGLWIPVPPDPNEFFVMVGDALQVLTNGRFASVRHRVLTNTTKARMSMMYFAAPPLNRWITPLPMMVTPHNPSLYKPFTWAQYKQAAYSLRLGDARLDLFKIQRQQDTHLAPASP

SEQ ID NO: 1229 - protein, 365 aa, Aspergillus kawachii IFO 4308
  misc_feature (1)..(365): Public GI ID no. 358368242
  misc_feature (1)..(365): Bit score of 56.5 for HMM based on sequences of FIGURE 5.
  misc_feature (185)..(294): Pfam Name: 2OG-FeII_Oxy Pfam Description: 2OG-Fe(II) oxygenase superfamily
  misc_feature (1)..(365): Functional Homolog Of SEQ ID NO. 287
MDKQAFQEEPPFPEGLNLAQLEVIDYDKLVNGPDADEAGRLFEACKHYGFFYLKLDHSEKGQQLLDLVKETFTLQKKVFDLPAEEKRPYDTGQFLGYTAPGGTVIDRNGTRDRMEVWNLGKDDIMQPGYSVPKPPLLLDSQKTLQNFTQSCHEVALTILAALESLLDLPKGTFADLHRLSAESGDHVRFLKVPPQPDTDRRTALGEHTDFGSITVLFNRLSGLRVVEPGRQYGENDWDEWPWVQPRPGNAIINLGDALVKFTNGLFRSNVHRVDPPLGTQKLVDRYSLIYFSRPRDDVVLKRLPGSGVIPPLADGVVEEELTSKEWIERRAAGKRHGKFKGPEHWDRMSGTESASKAKASPLVVV

SEQ ID NO: 1230 - protein, 333 aa, Zygosaccharomyces rouxii CBS 732
  misc_feature (1)..(333): Public GI ID no. 254583526
  misc_feature (1)..(333): Bit score of 68.4 for HMM based on sequences of FIGURE 5.
  misc_feature (173)..(289): Pfam Name: 2OG-FeII_Oxy Pfam Description: 2OG-Fe(II) oxygenase superfamily
  misc_feature (1)..(333): Functional Homolog Of SEQ ID NO. 287
MKLSVVDISKPEEQILEPLLEAATKQGFLLIDGHAFTQSEVDELFTISEGFFTGTGQNEKLKYPIDQRNFGYSGFNVENLNPNKSVDYKEGFNFSQINFADGIVNQTPNYELNQFDSTNPLPPFFSERLDFLSKIIIKLHAQARRIIQLLSMAMGVEDVNFFLKRFEPSKPSPSTFRMLHYPLVRSNSSGKADPHVRAGAHTDYGALTLLFQRKGEQGLQLQLDGCSWTDVEFVPTKHKGMAPPLVINFGDMMSYWTNGVLKSTMHRVRFEPGQTRDSDRYSMVFFFEPTVTTKLIPVPCEMVQTQKGQTVARPEMTSLEYLQKKLESTYSYR

SEQ ID NO: 1231 - protein, 335 aa, Oryza sativa Japonica Group
  misc_feature (1)..(335): Public GI ID no. 115435212
  misc_feature (1)..(335): Bit score of 395.5 for HMM based on sequences of FIGURE 5.
  misc_feature (180)..(285): Pfam Name: 2OG-FeII_Oxy Pfam Description: 2OG-Fe(II) oxygenase superfamily
  misc_feature (1)..(335): Functional Homolog Of SEQ ID NO. 287
MVVLAKGELEQIALPAAHPPPADVRAIDLSATGPARAAEARALVAACEEQGFFRVTGHGVPPGLVRAAEAAAARFFALPQPDKEAAAGAPLGYASKRIGSAGDLGWIEYLLLCLAPAAAAAALPCAATSPTPPCPLRELLREYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDGGRSRYREFTWKEYKGSGCKGRLADDRLCRFEN

SEQ ID NO: 1232 - protein, 368 aa, Ricinus communis
  misc_feature (1)..(368): Public GI ID no. 255557479
  misc_feature (1)..(368): Bit score of 157.9 for HMM based on sequences of FIGURE 5.
  misc_feature (207)..(305): Pfam Name: 2OG-FeII_Oxy Pfam Description: 2OG-Fe(II) oxygenase superfamily
  misc_feature (1)..(368): Functional Homolog Of SEQ ID NO. 287
MAYPQPSAAGFENFHSVLSLQELIKKPMVEIPPRYVFRSDDEETLNCHSFSTIIPTFDFKLLLSKETSDLEIEKLHSICKEWGIFQLVNHGVSSIMAKLNHEIEEFYKLPLEEKMKYKIRPGEFEGYGTISRMKGTLDWGDRFYMITNPITRRKPHLFPELPSSLRDSLESYLSEMQKIAMKLLEFLAQALNIDKKEMEELFDNGMQSMRMSYYPPCPQPELVVGITPHSDATGITILSQVNEVDGFQIKKDGVWMPVSFVPYALVVNLGDILQILSNGVYQSIEHRVTVNSEKERMSIAFFCNPKFEVEIGPAPSLINSQNPPQYRRIGMEDYVKGYFSQKLNRKSYLEKMKLQHEELVLEEKLDSN

SEQ ID NO: 1233 - protein, 332 aa, Medicago truncatula
  misc_feature (1)..(332): Public GI ID no. 357476439
  misc_feature (1)..(332): Bit score of 536.1 for HMM based on sequences of FIGURE 5.
  misc_feature (179)..(281): Pfam Name: 2OG-FeII_Oxy Pfam Description: 2OG-Fe(II) oxygenase superfamily
  misc_feature (1)..(332): Functional Homolog Of SEQ ID NO. 287
MVVLSQQATLNELFHINTCKPTSYVFKGVPEVDLSDPEAKTLIVNACTEFGFFKVVNHQVPLELITNLENETLKFFGQPQLEKEKAGPPDPFGYGSKIIGTNGDVGWVEYLLLNTNPDVISLKSLFLLQQNTKNFRCAAEEYIVAVKEVCCEVLELMADGLRIEPRNVFSRLVRDERSDSCLRVNHYAACGELQALSGGNLIGFGEHTDPQIISVLRSNNASGLQICLRDGTWVSIPPDHTSFFISVGDSLQVITNGELKSVKHRVLTDTSMSRLSMIYFGGPPLNEKLVPLPSILGSKEQQSLYKEFTWREYKNAAYKSKLAYNRLSLFEK

SEQ ID NO: 1234 - protein, 332 aa, Glycine max
  misc_feature (1)..(332): Public GI ID no. 356555146
  misc_feature (1)..(332): Bit score of 542.2 for HMM based on sequences of FIGURE 5.
  misc_feature (181)..(282): Pfam Name: 2OG-FeII_Oxy Pfam Description: 2OG-Fe(II) oxygenase superfamily
  misc_feature (1)..(332): Functional Homolog Of SEQ ID NO. 287
MAEQSGRKVVVLSKATTEQYSNIKNCMPTTFSSTIPIVDLSKPDAKTLIVKACEEFGFFKVINHGVPMEVISELESEAFKFFSLPLNEKEIVGPPNPFGYGNKKIGRNGDIGCVEYLLLSTSQEHNLSLYGKNPEKFRCLLNNYMSSIRKMACEILELMAEGLKIQQKDVFSKLLIDKQSDSVFRVNHYPANSKIPVNDQSLIGFGEHTDPQIISLLRSNNTSGLQICLKDGDWISVPHDQKSFFINVGDSLQVMTNGRFHSVKHRVLTNEFKSRLSMIYFGGPPLDEKITPLPSIMKGKESLYKEFTWSEYKNFTYGTKLADNRLGHFERN

SEQ ID NO: 1235 - protein, 306 aa, Trifolium repens
  misc_feature (1)..(306): Public GI ID no. 83033890
  misc_feature (1)..(306): Bit score of 138.9 for HMM based on sequences of FIGURE 5.
  misc_feature (157)..(253): Pfam Name: 2OG-FeII_Oxy Pfam Description: 2OG-Fe(II) oxygenase superfamily
  misc_feature (1)..(306): Functional Homolog Of SEQ ID NO. 287
MMNFPIISLERLNGVERKDTMAKIKDACENWGFFELVNHGIPHDLMDTLERLTKEHYRKCMEQRFKELVSSKGLDAVQTEVKDMDWESTFHVRHLPESNISELPDLSDEYRKVMKEFSLRLEKLAEELLDLLCENLGLEKGYLKKAFYGSRGPTFGTKVANYPQCPNPELVKGLRAHTDAGGIILLFQDDKVSGLQLLKDDEWIDVPPMRHSIVVNLGDQLEVITNGKYKSVEHRVIAQTNGTRMSIASFYNPGSDAVIYPAPELLEKETEEKTNVYPKFVFEEYMKIYAALKFQAKEPRFEALKA

SEQ ID NO: 1236 - protein, 359 aa, Medicago truncatula
  misc_feature (1)..(359): Public GI ID no. 358348748
  misc_feature (1)..(359): Bit score of 168.3 for HMM based on sequences of FIGURE 5.
  misc_feature (77)..(93): Pfam Name: 2OG-FeII_Oxy Pfam Description: 2OG-Fe(II) oxygenase superfamily
  misc_feature (1)..(359): Functional Homolog Of SEQ ID NO. 287
MEGIKNPSGTSLLVPSVQELSKDGNISTVPPRYIQPNHQDLILSEVDTNLQIPVIDMYKLHSEEFGSSELLKFHLACKDWGFFQLVNHGVSSNLIEKIKLEIQDFFNLPMSEKKKFWQTPQHMEGFGQAFVMSEEQKLDWADMFYMTTLPKHSRMPHLFPQLPHPLRDTLELYSQEMKNKAMVIVGHIEKALKIKENEIRELFEDGIQMMRMNYYPPCPQPEKVIGLTNHSDPQGVTLLLQLNEVEGLQIRKDGMWVPVKPLPNAFIVNIGDVLEILTNGIYRSIEHRAIVDTKKERLSIATFHSLNQDGIVGPLESLITEETPPRFKKVGVDEYFKNFFARKLEGKAFIDDMRIEHDD

SEQ ID NO: 1237 - protein, 279 aa, Vibrio orientalis CIP 102891 = ATCC 33934
  misc_feature (1)..(279): Public GI ID no. 261251140
  misc_feature (1)..(279): Bit score of 73.8 for HMM based on sequences of FIGURE 5.
  misc_feature (150)..(253): Pfam Name: 2OG-FeII_Oxy Pfam Description: 2OG-Fe(II) oxygenase superfamily
  misc_feature (1)..(279): Functional Homolog Of SEQ ID NO. 287
MKLETVDYQAENAAELFVTSLRETGFGVLKNHPIPKELVESIYENWYKFFTSERKEEFHFNVETQDGYFPPNVSEVAKGHTVKDIKEYFHVYPWGQIPEELKEQILDYYNRANAFAEELLGWVEAHAPADVQEKFSIALSEMINGSEKTLLRILHYPPMTGDEEPGAIRAAAHEDINLLTVLPAANEPGLQVLSKEGDWLDVPCDFGNLIINIGDMLQEASGGYFPSTTHRVINPTGARQEQSRISLPLFLHPKPEVVLSERYTADSYLMERLRELGVI

SEQ ID NO: 1238 - protein, 361 aa, Arabidopsis lyrata subsp. lyrata
  misc_feature (1)..(361): Public GI ID no. 297829900
  misc_feature (1)..(361): Bit score of 181.7 for HMM based on sequences of FIGURE 5.
  misc_feature (215)..(312): Pfam Name: 2OG-FeII_Oxy Pfam Description: 2OG-Fe(II) oxygenase superfamily
  misc_feature (1)..(361): Functional Homolog Of SEQ ID NO. 287
MAPTLSTTQFSNPAEVTDFVVHKGNGVKGLSETGIKALPDQYIQPFEERLINKFVNETDEAIPVIDMSNPDENRVAEAVCDAAEKWGFFQVINHGVPLEVLDDVKAATHRFFNLPVEEKCKFTKENSLSTTVRFGTSFSPLAEQALEWKDYLSLFFVSEAEAEQFWPDICRNETLEYIDKSKKMVRKLLEYLGKNLNVKELDETKESLFMGSIRVNLNYYPICPNPDLTVGVGRHSDVSSLTILLQDQIGGLHVRSLASGNWVHVPPVPGSFVINIGDAMQILSNGRYKSVEHRVLANGNNNRISVPIFVNPKPESVIGPLPEVIANGEEPIYRDVLYSDYVKYFFRKAHDGKKTVDYAKI

SEQ ID NO: 1239 - protein, 396 aa, Magnaporthe oryzae 70-15
  misc_feature (1)..(396): Public GI ID no. 39950534
  misc_feature (1)..(396): Bit score of 61.0 for HMM based on sequences of FIGURE 5.
  misc_feature (179)..(282): Pfam Name: 2OG-FeII_Oxy Pfam Description: 2OG-Fe(II) oxygenase superfamily
  misc_feature (1)..(396): Functional Homolog Of SEQ ID NO. 287
MSFTSIPVLDLSLASSPTTKPAFLADLRSALMEVGFLYLKNVGIPDSLFASAISHGRAFFELPLDEKLKIEMKNAPSFLGYSRLSAEVTAGAIDHREQIDLSTEHVVPTAPDTPRYYNLLGPNQWPDEAALPGFRDTFTAYMTAMGAVSMRFTALVAEAIGLPASAFERYFERSIQDQQHKLKIVKYPDVGELGADGAARQGVGPHKDSMYTSYLLQASGHRGLQVQNLRGDWVDCPPVDGTLVVAIGQGLEALTGGVCASTTHRVLSPAAGEGARFSIPFFQGVRLDTEFEELETAGLGRAVPEEVREQRRRVLLEGSGQRLDDVEFTFRTGGVAKTLGEATLRNRVKSHPDVGERWYPDILASIREEQRIAGRQGAGTSTAPGVEKLRGDAQAV

SEQ ID NO: 1240 - protein, 342 aa, Glycine max
  misc_feature (1)..(342): Public GI ID no. 356503948
  misc_feature (1)..(342): Bit score of 382.8 for HMM based on sequences of FIGURE 5.
  misc_feature (175)..(277): Pfam Name: 2OG-FeII_Oxy Pfam Description: 2OG-Fe(II) oxygenase superfamily
  misc_feature (1)..(342): Functional Homolog Of SEQ ID NO. 287
MVVLSPSPTSIKTSYKKKKTMKIPTIDLSMERTELSETVVKACEEYGFFKVINHNVPKEVIARMEEEGAKFFAKPTHEKRRAGPASPFGYGFTNIGPNGDKGDLEYLLLHANPLSVSQRSKTIASDSTKFSCVVNDYVEAVKEVTCEILDLVLEGLGVPEKFALSKLIRDVNSDCVLRINHYPPLNQKLKGNKNSIGFGAHSDPQILTIMRSNDVGGLQIYTREGLWIPIPPDPNQFFVMVGDVFQVLTNGKFMSVRHRALTNTLGARMSMMYFAAPPLDWWITPLAKMVSPPQNPSLYKPFTWDHYKKATYSLRLGDSRLDLFKAQLDTHHVSVSPSQIQC

SEQ ID NO: 1241 - protein, 319 aa, Actinidia chinensis
  misc_feature (1)..(319): Public GI ID no. 343794766
  misc_feature (1)..(319): Bit score of 140.0 for HMM based on sequences of FIGURE 5.
  misc_feature (157)..(253): Pfam Name: 2OG-FeII_Oxy Pfam Description: 2OG-Fe(II) oxygenase superfamily
  misc_feature (1)..(319): Functional Homolog Of SEQ ID NO. 287
MEAFPVIDMEKLTGKERSPTMEKINDACENWGFFELMNHGISHELMDTVERLTKEHYKKCMEQRFKEMVATKGLEAVQSEIDDLDWESTFFLRHLPVSNISEIPDLEQDHRKSMKEFAEKLEKLAEQLLDLLCENLGLEKGYLKKAFSGSKGPTFGTKVSNYPPCPQPELIKGLRAHTDAGGIILLFQDNKVSGLQLLKEGEWIDVPPMKHAIVINIGDQLEVITNGKYKSVMHRVIAQTDGNRMSIASFYNPGSEAVIYPAPALVDKEEDQQKQVYPKFVFEDYMKLYAGLKFQAKEPRFEAMKAMESAVKLGPISTI

SEQ ID NO: 1242 - protein, 311 aa, Micavibrio aeruginosavorus ARL-13
  misc_feature (1)..(311): Public GI ID no. 347758670
  misc_feature (1)..(311): Bit score of 46.2 for HMM based on sequences of FIGURE 5.
  misc_feature (164)..(254): Pfam Name: 2OG-FeII_Oxy Pfam Description: 2OG-Fe(II) oxygenase superfamily
  misc_feature (1)..(311): Functional Homolog Of SEQ ID NO. 287
MIPVFDLRDYDADPAAFAAAFGKAFHDFGFVRVRGHGISKDIITQAEDNARQFFRKRPATKDRHQMHGNEGLIGYSRNHETARGQDVPDMKEQWNIRARLPSGHPLAGQEQKILTVPRQSSFKPSMMSLYSAFEDLTARVVKPLAVYMGEDEAFFDDKLQDSLSMMRLLHYPKAGSAANHLDLNFLTWLRADEPGLFVTARDGHEYAVVAESDDELILNGGMMLGLMTNNDLKPSWHRVEAHSPRQTIVFFVHPNPDVILTPLKKFNQVADGVRPDYFPPAGADGRVAVSVRDFVTWQIQQIHKTKDAPKP

SEQ ID NO: 1243 - protein, 355 aa, Medicago truncatula
  misc_feature (1)..(355): Public GI ID no. 357488575
  misc_feature (1)..(355): Bit score of 171.2 for HMM based on sequences of FIGURE 5.
  misc_feature (203)..(299): Pfam Name: 2OG-FeII_Oxy Pfam Description: 2OG-Fe(II) oxygenase superfamily
  misc_feature (1)..(355): Functional Homolog Of SEQ ID NO. 287
MALEASSIIVPSVQELIKQPITEIPERYFHSNQDTIVVTNTTSLPHVPIIDLHKLLSDDSAELEKLDQTCKEWGFFQLINHGVNTSLVENMKIGVEQFFNLPMEEKKKKFWQTPNDIQGFGQLFVVSEEQKLEWADMFYINTLPLDSRHQHLIPSIPTPFRDHLENYCLVVKKLAITIIGRMEKALKIKSNELVELFDDINQGMRMNYYPPCPQPENVIGLNPHSDMGMLTILLQANDIEGLQIRKDGQWIPVQPLPNAFVVNLGDMLEIFTNGIYRSIEHRGIVNSKKERISIATFHRLNMSRVIGPTPNLITAERSALFNPIRVADYIKGYLSRQLEGKSYLDVVRIQKEMDK

SEQ ID NO: 1244 - protein, 318 aa, Prunus persica
  misc_feature (1)..(318): Public GI ID no. 7108579
  misc_feature (1)..(318): Bit score of 142.9 for HMM based on sequences of FIGURE 5.
  misc_feature (158)..(253): Pfam Name: 2OG-FeII_Oxy Pfam Description: 2OG-Fe(II) oxygenase superfamily
  misc_feature (1)..(318): Functional Homolog Of SEQ ID NO. 287
METFPVVDLSQITGEKREAAMEKMNDACENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQLEVITNGKYKSVMHRVIAQPDGTRMSIASFYNPGDDAFICPAPALLEKETENISAYPKFVFDDYMKLYSGLKFHAKEPRFEAMKAMESTVNLDPVATV

SEQ ID NO: 1245 - protein, 327 aa, Ajellomyces dermatitidis ATCC 18188
  misc_feature (1)..(327): Public GI ID no. 327348464
  misc_feature (1)..(327): Bit score of 44.7 for HMM based on sequences of FIGURE 5.
  misc_feature (177)..(290): Pfam Name: 2OG-FeII_Oxy Pfam Description: 2OG-Fe(II) oxygenase superfamily
  misc_feature (1)..(327): Functional Homolog Of SEQ ID NO. 287
MATTFPALPIVDLSPLKSSHELGAEQQKDLASQLYNVFATTGFAYLVNHPLSFDHQVLFDISRDFFALPTEEKMKYFPMQPDLASDNLKEGFEIGPQKSIPQTPASNSISNATHLPKINLSEPNVWPAPAVFPSRAKLELLHNELQALASTLLSLLAISLGKEADFFSSYLTDSLSTLRLLHYPPTSSTSTQFQGGGDGILTLLHQDATGGLEVQNADGKWVAAPYVPKSIVVNIVDLMAKVSCGRFVATMHRVRAPPATAPTSISASSANAAAAMQQSGRFSMPFFFEPGEKCLIKSVDDELGVDAVVYGEHVRAKMKTWVEFQDL

SEQ ID NO: 1246 - DNA, 843 bp, Populus balsamifera subsp. trichocarpa
  misc_feature (1)..(843): Ceres Annot ID no. 1464270
  misc_feature (1)..(843): Encodes the peptide sequence at SEQ ID NO. 1247
atgaagataagctctgcaatgagcggctacatagaagcagttagggagctggcatgtgagttattagatctgatggcagagggattgtgggtcccagatagatcagtgttcagtcgactaatcagagatgatgacagtgactcaatcatcaggttaaatcactaccctgccatgcctatactctgcaaggataaggactcctcatcaccttgtaaccacaacaaggtaggatttggagagcattctgaccctcagatcttgaccatcttaagatccaacgacgtgggtggccttcagatttccctgaatgatggtgcctgggttccagtaacacctgaccccactgccttctgtgttaatgtgggtgacttgttacaggcaatgacaaatgggagatttgtaagtgtgaggcacaaagccctaaccaactcatacaagtctagaatgtcaatggcctattttgctgcacccccacttaatgcaaggatcgctgttccaccagaaatggttacacccatcaagcctgccttatacaggcctttctcctgggctgaattcaagaatgctgcttttgctctgcgacttggagatagccgccttggtctattcatgctggaagtagatgaccaagtatatagctcccgagtcaggaaatacctactcaggcacgaatttgagatcttgcagcaaggcaagaacacttctactgaccagttctgcttagtgcacaaacacaaatctccaggatctcataatcctcgtcccataacaacaaggatgccttctctgggctctctaaaatcatctttgaatgttaggaaaccagagactgtccatgtctga

SEQ ID NO: 1247 - protein, 280 aa, Populus balsamifera subsp. trichocarpa
  misc_feature (1)..(280): Ceres Annot ID no. 1464270
  misc_feature (1)..(280): Bit score of 251.6 for HMM based on sequences of FIGURE 5.
  misc_feature (47)..(157): Pfam Name: 2OG-FeII_Oxy Pfam Description: 2OG-Fe(II) oxygenase superfamily
  misc_feature (1)..(280): Functional Homolog Of SEQ ID NO. 287
MKISSAMSGYIEAVRELACELLDLMAEGLWVPDRSVFSRLIRDDDSDSIIRLNHYPAMPILCKDKDSSSPCNHNKVGFGEHSDPQILTILRSNDVGGLQISLNDGAWVPVTPDPTAFCVNVGDLLQAMTNGRFVSVRHKALTNSYKSRMSMAYFAAPPLNARIAVPPEMVTPIKPALYRPFSWAEFKNAAFALRLGDSRLGLFMLEVDDQVYSSRVRKYLLRHEFEILQQGKNTSTDQFCLVHKHKSPGSHNPRPITTRMPSLGSLKSSLNVRKPETVHV

SEQ ID NO: 1248 - protein, 369 aa, Aspergillus flavus NRRL3357
  misc_feature (1)..(369): Public GI ID no. 169777699
  misc_feature (1)..(369): Bit score of 41.6 for HMM based on sequences of FIGURE 5.
  misc_feature (183)..(291): Pfam Name: 2OG-FeII_Oxy Pfam Description: 2OG-Fe(II) oxygenase superfamily
  misc_feature (1)..(369): Functional Homolog Of SEQ ID NO. 287
MATNTSSFTAIPILDYSLSTSPTTKPQFLAELRNALINVGFFYLIHAPIAPQIQKDVVDKCKDIFDLPLEKKVEIEMVNSKHFLGYSRLGAEITAREQDYREQFDFATELPAPGPSEPLYRNIRGPNQWPDESAIPGFRKAIEAYLAEISPLSDAFRGLISEALDLPPTALDPYFDDPQQLKLKLIKYPPPPISSTEAEVQGVGPHKDSEFLTFLLQASPHSGLEVQNKSGDWISAAPVENSLVVNIGRALEAITGGVCTATTHRVSLAPRNFIDQAGASLGPRFSIPVFLGMGLDLSAEKITLQIPQHVRDLIQDEKVRSDAEATFNRIFSGRTGEGTLLHRVISHQDVGRRWYPDLLDFALKQYETK

SEQ ID NO: 1249 - protein, 356 aa, Arabidopsis lyrata subsp. lyrata
  misc_feature (1)..(356): Public GI ID no. 297803592
  misc_feature (1)..(356): Bit score of 174.8 for HMM based on sequences of FIGURE 5.
  misc_feature (210)..(306): Pfam Name: 2OG-FeII_Oxy Pfam Description: 2OG-Fe(II) oxygenase superfamily
  misc_feature (1)..(356): Functional Homolog Of SEQ ID NO. 287
MEGQRATQSSIIVPSVQEMVKENMITAVPPRYVRSDQDKAEIAVDSGLRNQIPIIDMCLLCSPTCMDSETDKLDFACKEWGFFQLVNHGMDSSFLDKFKTEIQDFFNLPMEEKKKLWQQPGDIEGFGQAFVVSEEQKLDWADMFFLTMQPVQLRKPHLFPKLPLPFRDTLDMYSAEVKSIAKVLFGKIASALKIKPEEMEKLFDDELGQRIRMNYYPPCPEPDKVIGLTPHSDATGLTILLQVNEVDGLQIKKDGKWVSVKPLPNAFVVNVGDILEIITNGTYRSIEHRGVVNSEKERLSVATFHNTGMGKEIGPMRSLVERHKAAFFKNVTTEEYFNGLFSRELDGKAYLDVMRI

SEQ ID NO: 1250 - protein, 344 aa, Brachypodium distachyon
  misc_feature (1)..(344): Public GI ID no. 357127376
  misc_feature (1)..(344): Bit score of 392.5 for HMM based on sequences of FIGURE 5.
  misc_feature (190)..(293): Pfam Name: 2OG-FeII_Oxy Pfam Description: 2OG-Fe(II) oxygenase superfamily
  misc_feature (1)..(344): Functional Homolog Of SEQ ID NO. 287
MVVLAKGELEQIALPAAQSPPANVQAVDLSSARRSGPGRAAAARALVAACEEQGFFKVTGHGVAPALVRALDAAAAAFFALPQAEKEAAAGRPVGYASKRIGTAGDLGWIEYLLLCVAPGAGQALPVPASASFSTLPCAAAAAAAAAGLLEEYAAALRRMACEVLELMAEGLGLAPSDAISRLVSDGGSDNMLRVNHYPPRPELQAGKNQLLTGFGEHTDPQIISVLRSNGTSGLEIASPRDGAWASVPPDADSFFINVGDVLQVLTNGRFRSVKHRVVVNSERPRMSMIFFGGPPPGERLAPLRELLGDDGGRSRYREFTWKEYKSTGCRGRLAEDRLCLFEN

SEQ ID NO: 1251 - protein, 383 aa, Brachypodium distachyon
  misc_feature (1)..(383): Public GI ID no. 357128527
  misc_feature (1)..(383): Bit score of 398.5 for HMM based on sequences of FIGURE 5.
  misc_feature (183)..(286): Pfam Name: 2OG-FeII_Oxy Pfam Description: 2OG-Fe(II) oxygenase superfamily
  misc_feature (1)..(383): Functional Homolog Of SEQ ID NO. 287
MVAIKAPSSIDHANPLTKSPKAAAAAAAAIPTVDLSSPGAARAVADACRGVGFFRATNHGIPSSLAAALEARAMAFFALPHEDKVDATIAAAARRPFGYGSRSIGSNGDVGWLEYLLLSLGSNSNSSSIPGASSLPPSLRAALEEYTGAVRNASGKVLELMAEGLGMQERCALRRMVDGSEEELVRVNHYPPTKEEDCVAGMTGFGEHTDPQIISLLRSNRTAGLQIKLQGPDAPWVNVAPDPDSLFVNVGDCLQVLTNGRFRSVKHRVVAPEGAQASRLSVIYFGGPAPAQRIAPLPELMREGEQSLYRDFTWGEYKAAAYKTRLGDNRLGPYELRNVADTNPTALITASKEPTAADHCCSNSSSSSAACVVVQPPHVAQVH

SEQ ID NO: 1252 - protein, 347 aa, Medicago truncatula
  misc_feature (1)..(347): Public GI ID no. 357485645
  misc_feature (1)..(347): Bit score of 163.0 for HMM based on sequences of FIGURE 5.
  misc_feature (200)..(296): Pfam Name: 2OG-FeII_Oxy Pfam Description: 2OG-Fe(II) oxygenase superfamily
  misc_feature (1)..(347): Functional Homolog Of SEQ ID NO. 287
MESFQLANESSPLSLTPNFILPEHKRPHLSEVKYLDSIPIIDLSYCDGNNPSSLEVIHKISKACEEFGFFQIVNHGVPDQVCTKMMKAITNFFELAPEEREHLSSTDNTKNVRLFNYYLQVDGGEKVKLWSECFAHPWYPIDDIIQLLPEKIGTQYREAFTEYAKEVGSLVRRLLSLISIGLGLEEDCLLKKLGEQPRQRAQSNFYPPCPDPELTMGLNEHTDLNALTVLLQSEVSGLQVNKDGKWISIPCIPNAFVINLADQIEVLSNGRYKSVLHRAVTNNVQPRISMAMFYGPNPETIIGPIHELIDEEHPPKYRNYHFSKFLEEFFNQEGTRRIVKEVFELPC

SEQ ID NO: 1253 - DNA, 1419 bp, Zea mays
  misc_feature (1)..(1419): Ceres Clone ID no. 387918
  misc_feature (1)..(1419): Encodes the peptide sequence at SEQ ID NO. 1254
aacaaaagaaacggacggctatgagaaatcttgggacccggctatacatatggccacctcacataaagactcgatcgacgatgcagggcaagacgagatcatcttggttcgcaagcaaaccaagataggccaggtcgtctcgttggttgttgcattggaggagcgagcaggtgccatggcagccgctgagatcaagataggccaggtcgacgacgtccaggagctgcaccggacgggcctgcagacggtgccggaccggtacatcagggacggcgacgaccggccggacggcgacaacgtctgcgctgtcgcgcacatcccggtgatcgacgtcgccgagctccagcgcgacgacgtcgggcttgacaagctcaggctcgcctgcgaggagtggggcttcttccaggttgtgaaccatggcatcgcgcacgagctgctggacgagatggagaggctggcgagggagttcttcatgctcccgctggaggagaaggagaagtaccccatggcgccgggcgggatccaggggtacggccacgcgttcgtcttctccgaggaccagaagctggactggtgcaacatgctggcgctgggcgtggagccggcgtccatccggcagccgaggctgtggccgacggccccggccgggttcggggagaccctggagacctactccgcggaggtcggggagctctgccggaggctgctcgcgcgcatcgccgagacgctgggcctggcgccggccacgttcgccgacatgttcggcgaggcggtgcaggcggtgcggatgaacttctacccgccgtgcccgcgcccggacctggtcatggggctcagcgcgcactcggacggcagcgccgtaacggtgctccagcaggacgcgggctgcgccggcctgcaggtgcgcggcaagggcggcgcctgggtacccgtgcaccccgtcccgcacgccctcgtcgtcaacatcggcgacaccctagaggttctgacgaacggcaggtacaagagcgtggagcaccgtgcggtggccaacggcgagcaggaccggctgtcggtggtgacgttctacgcgccggcctacgacgtcgagctgggaccgctgccggagttcgtcaccgacgaggcgccgtgccggtaccggaggttcaaccacggcgagtacagccgccactacgtcaccagcaggctcgagggcaagaagacgctcgagttcgccaagattgatccgctggccggagagcacgacggcacagctcccgaggaaacctctacctagtactactgtctagctgcatagaatacggtttggtcgatgaagcacaagctgcctctctacctacctgggctttgcaaatttgcaaaaggaaactactgtgctaccgaagcatgcagtgccgtatcaatcacctttcttatctt

SEQ ID NO: 1254 - protein, 408 aa, Zea mays
  misc_feature (1)..(408): Ceres Clone ID no. 387918
  misc_feature (1)..(408): Bit score of 187.7 for HMM based on sequences of FIGURE 5.
  misc_feature (244)..(342): Pfam Name: 2OG-FeII_Oxy Pfam Description: 2OG-Fe(II) oxygenase superfamily
  misc_feature (1)..(408): Functional Homolog Of SEQ ID NO. 287
MATSHKDSIDDAGQDEIILVRKQTKIGQVVSLVVALEERAGAMAAAEIKIGQVDDVQELHRTGLQTVPDRYIRDGDDRPDGDNVCAVAHIPVIDVAELQRDDVGLDKLRLACEEWGFFQVVNHGIAHELLDEMERLAREFFMLPLEEKEKYPMAPGGIQGYGHAFVFSEDQKLDWCNMLALGVEPASIRQPRLWPTAPAGFGETLETYSAEVGELCRRLLARIAETLGLAPATFADMFGEAVQAVRMNFYPPCPRPDLVMGLSAHSDGSAVTVLQQDAGCAGLQVRGKGGAWVPVHPVPHALVVNIGDTLEVLTNGRYKSVEHRAVANGEQDRLSVVTFYAPAYDVELGPLPEFVTDEAPCRYRRFNHGEYSRHYVTSRLEGKKTLEFAKIDPLAGEHDGTAPEETST

SEQ ID NO: 1255 - protein, 333 aa, Glycine max
  misc_feature (1)..(333): Public GI ID no. 363807830
  misc_feature (1)..(333): Bit score of 592.7 for HMM based on sequences of FIGURE 5.
  misc_feature (49)..(59): Pfam Name: 2OG-FeII_Oxy Pfam Description: 2OG-Fe(II) oxygenase superfamily
  misc_feature (1)..(333): Functional Homolog Of SEQ ID NO. 287
MVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALYGRNLVEFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAAD

SEQ ID NO: 1256 - protein, 365 aa, Aspergillus niger CBS 513.88
  misc_feature (1)..(365): Public GI ID no. 317031438
  misc_feature (1)..(365): Bit score of 45.5 for HMM based on sequences of FIGURE 5.
  misc_feature (181)..(287): Pfam Name: 2OG-FeII_Oxy Pfam Description: 2OG-Fe(II) oxygenase superfamily
  misc_feature (1)..(365): Functional Homolog Of SEQ ID NO. 287
MISSSSSFTSIPVLDYAQASSADDRPKFLANLRNALVNVGFFYLINAPIAARVRDELIEKTFHIFDLPLEKKLEIEMVNSKHFLGYSRLGAETTARQIDYREQFDFATELPPPAPDAPLYRNIRGPNQWPDEKAIPGFRHAVEAYLAEMSPVAEAFRTLIAEALDLPPTALQQFFENPTQQKLKLIKYPPPSTPSEAQGVGAHKDSEFLTFLLQATPHTGLEVQNKAGEWIPAPPMQDSLVVNIGRALEAITGGVCTATTHRVNLEAENFVDAQGAPLGPRFSIPVFQGMSLDLSAENISLDIPEHIKDLIKDDKVRSDAEATFNKIFKGRVGEGTLIHRVMSHQDVGRRWYPELLDWALGEYEK

SEQ ID NO: 1257 - protein, 192 aa, Hordeum vulgare subsp. vulgare
  misc_feature (1)..(192): Public GI ID no. 326534020
  misc_feature (1)..(192): Bit score of 302.8 for HMM based on sequences of FIGURE 5.
  misc_feature (24)..(130): Pfam Name: 2OG-FeII_Oxy Pfam Description: 2OG-Fe(II) oxygenase superfamily
  misc_feature (1)..(192): Functional Homolog Of SEQ ID NO. 287
MVAEGLGVSPRGALADMVTGEASDQVFRVNHYPPCPLLQGLPPNCSVTGFGEHTDPQLVSILHSNGTAGLQVALHNGRWVSVPPNRDAFFVKVGDSLQVLTNGRLRSVRHRVVAGNGLKSRVSMIYFAGPPLAQRIAPLQQLLAGTQSLPLYRDFTWGEYKKAAYRSRLGDNRLAPFETPLVAMPHAAHHRS

SEQ ID NO: 1258 - protein, 279 aa, Shewanella putrefaciens CN-32
  misc_feature (1)..(279): Public GI ID no. 146292853
  misc_feature (1)..(279): Bit score of 80.2 for HMM based on sequences of FIGURE 5.
  misc_feature (149)..(253): Pfam Name: 2OG-FeII_Oxy Pfam Description: 2OG-Fe(II) oxygenase superfamily
  misc_feature (1)..(279): Functional Homolog Of SEQ ID NO. 287
MKLETIDYRAENSAQQFVESLRETGFGVLSNHPIDKRLVEDIYTEWQAFFNSEAKNDYMFKKETHDGFFPASISETAKGNTVKDIKEYYHVYPWGRIPDSLRTNILAYYDKANALAAELLEWIETYSPEDIKAKFSMPLPEMIANSQKTLLRILHYPPMTGSEEMGAIRAAAHEDINLITVLPAANEPGLQVKAKDGTWLDVPSDFGNIIINIGDMLQEASGGYFPSTSHRVINPEGTDKTKSRISLPLFLHPNPAVVLSDRYTADSYLMERLRELGVI

SEQ ID NO: 1259 - protein, 330 aa, Gordonia alkanivorans NBRC 16433
  misc_feature (1)..(330): Public GI ID no. 343925590
  misc_feature (1)..(330): Bit score of 83.6 for HMM based on sequences of FIGURE 5.
  misc_feature (168)..(265): Pfam Name: 2OG-FeII_Oxy Pfam Description: 2OG-Fe(II) oxygenase superfamily
  misc_feature (1)..(330): Functional Homolog Of SEQ ID NO. 287
MLPILDLGDADTAPATFRAALREAAHDHGFFYLTGHGVPGESLTEVMRLAREFFALPDEAKNEISQLQSPQFRGYSRLGGELTNGKVDWREQIDIGPERAVIPGAEGYWRLQGPNLWPSSPAGFRTAFEDWGAALSEVGLRLLRHWSVSLGAPESFFDAAFAELPATLIKVVRYPGTADSAQGVGAHKDSGVLTLLLVEPGSEGLEVETAAGSWVEVPPVEGAFIVNIGELLEVATGGYLRATRHRVRAPRPGTDRVSIPFFLNPALDEVIPIIDLPPELATASRGVETDPDNPIFSTYGENAWKSRTRAHPDVAELHHGIIPSQPVSAY

SEQ ID NO: 1260 - protein, 344 aa, Brugmansia x candida
  misc_feature (1)..(344): Public GI ID no. 123906
  misc_feature (1)..(344): Bit score of 149.8 for HMM based on sequences of FIGURE 5.
  misc_feature (195)..(292): Pfam Name: 2OG-FeII_Oxy Pfam Description: 2OG-Fe(II) oxygenase superfamily
  misc_feature (1)..(344): Functional Homolog Of SEQ ID NO. 287
MATFVSNWSTKSVSESFIAPLQKRAEKDVPVGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 1261 - protein, 380 aa, Brachypodium distachyon
  misc_feature (1)..(380): Public GI ID no. 357129744
  misc_feature (1)..(380): Bit score of 309.7 for HMM based on sequences of FIGURE 5.
  misc_feature (48)..(61): Pfam Name: 2OG-FeII_Oxy Pfam Description: 2OG-Fe(II) oxygenase superfamily
  misc_feature (1)..(380): Functional Homolog Of SEQ ID NO. 287
MVVPSSTTPARQEIATAAAALQLPAIPTVDMSAPRGLLSRQVARACAEQGFFRAVNHGVLVPGPAPAARQLDAATAAFFALPAHEKQRARGVQGQGPPSSPLGYGCRTIGFSGDVGELEYLLLHANDPAYKAASIHAHDPKHFSCVVNEYVEAVKQLACDILDLLGEGLGLEDPRSFSKLITEPDSDSLLRINHYPPSCTVHKLDHDGQCKLKGTACRAKAGNGGNPTGGGRIGFGEHSDPQILSLLRANDVDGLQVLLPDVNGKEVWIQVPADSSAFFVNVGDLLQALTNGKLLSVRHRVIASACRPRLSTIYFAAPPLHARISALPETVTAGSPRRYRSFTWAEYKTTMYSLRLSHSRLDLFCVHDDDDNSSDVSKEK

SEQ ID NO: 1262 - protein, 326 aa, Glycine max
  misc_feature (1)..(326): Public GI ID no. 356556910
  misc_feature (1)..(326): Bit score of 567.8 for HMM based on sequences of FIGURE 5.
  misc_feature (173)..(273): Pfam Name: 2OG-FeII_Oxy Pfam Description: 2OG-Fe(II) oxygenase superfamily
  misc_feature (1)..(326): Functional Homolog Of SEQ ID NO. 287
MVLLSKATTEQYSYIKNYMPTAFSSTIPVVDLSKPDAKTLIVKACEEFGFFKVINHGVPMETISQLESEAFKFFSMPLNEKEKVGPPKPYGYGSKKIGHNGDVGWVEYLLLNTNQEHNFSVYGKNAEKFRCLLNSYMSSVRKMACEILELMAEGLKIQQKNVFSKLLMDKESDSVFRVNHYPACPELVNGQNMIGFGEHTDPQIISLLRSNNTSGLQIFLRDGNWISVPPDHKSFFINVGDSLQVMTNGRFRSVKHRVLTNGFKSRLSMIYFGGPPLSEKIVPLSSLMKGKESLYKEFTWFEYKNLTYASRLADNRLGHFERIVAS

SEQ ID NO: 1263 - protein, 309 aa, Pisum sativum
  misc_feature (1)..(309): Public GI ID no. 5579094
  misc_feature (1)..(309): Bit score of 539.3 for HMM based on sequences of FIGURE 5.
  misc_feature (156)..(258): Pfam Name: 2OG-FeII_Oxy Pfam Description: 2OG-Fe(II) oxygenase superfamily
  misc_feature (1)..(309): Functional Homolog Of SEQ ID NO. 287
MPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQEHNFSLYGEDIDKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 1264 - protein, 317 aa, Vigna radiata
  misc_feature (1)..(317): Public GI ID no. 86197901
  misc_feature (1)..(317): Bit score of 143.7 for HMM based on sequences of FIGURE 5.
  misc_feature (40)..(59): Pfam Name: 2OG-FeII_Oxy Pfam Description: 2OG-Fe(II) oxygenase superfamily
  misc_feature (1)..(317): Functional Homolog Of SEQ ID NO. 287
MANFPVVDMGKLNTEERGAAMEMIKDACENWGFFELVNHGISIELMDTVERLTKEHYKKTMEQRFKEMVANKGLESVQSEINDLDWDSTFFLRHLPVSNVSENTDLDQDYRKIMKQFAEELEKLAEHLLDLLCENLGLEKRYLKQVFYGSKGPNFGTKVSNYPPCPTPDLIKGLRAHTDAGGIILLFQDDKVSGLQLLKDDQWIDVPPMRHSVVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 1265 - DNA, 1011 bp, Sorghum bicolor
  misc_feature (1)..(1011): Ceres Annot ID no. 8660515
  misc_feature (1)..(1011): Encodes the peptide sequence at SEQ ID NO. 1266
atggcgccggaatcgctcccgctcggcattatcccgacggtggacatgtcggcgccgtgcggcgagctggcgcgccggctggtgcgcgcgtgcgcggagcgcggcttcttcaaggccgtcaaccacggcgtgccgccgcgggtgtccgcgcggatggacgccgccgcgtcggcgttcttcgcgcgccccgggcaggcgaagcaggcggcggggccgcccgacccgctcgggtatggcagccggaacattggtgccaacggcgacgtcggcgagctggagtacctcatcctgcacgccgatcccggcgcagtggcgcgcaaggccaaggtcatcgacaaggacgatccttcgcggttcagtgtcgcagtgaacgagtacgtgggcgcagtgcggcacctcgcgtgccgggtcctggacctcctcggcgagggcctcggcctcagggacccgacgtccttgagccgcctcatctccgccgtcgacagcgactccctcctcaggatcaaccactaccctacgtccaggtccagcgcggcggacatctccaccaagggcatcgggttcggcgagcacaccgacccgcagatcctcagcctgctccgcgccaacgacgtcgacggcctgcaggtgctgctgcccgacggccacggcggcggcgacgagcagtgggtccaggtgccggctgacccgtccgccttcttcatcaacgtcggtgatctccttcaggccctgacaaacgggcggttggtgagcatccggcacagggtgatggccagcaccaccaggccgcggctgtccaccatctacttcgccgcgccgccgctcgacgcccgtgtcgcggcgctgccggagacggtgactgccggcgcgccgcggcggtacaggaccttcacgtgggcggagtacaagaaggccatgtacgcgctccgcctcagccacaaccgtcttgatctcttccacgcaacctctggcagcagccgcgatgtcatcgatgatgatcacgaacaataa

SEQ ID NO: 1266 - protein, 336 aa, Sorghum bicolor
  misc_feature (1)..(336): Ceres Annot ID no. 8660515
  misc_feature (1)..(336): Bit score of 361.3 for HMM based on sequences of FIGURE 5.
  misc_feature (33)..(52): Pfam Name: 2OG-FeII_Oxy Pfam Description: 2OG-Fe(II) oxygenase superfamily
  misc_feature (1)..(336): Functional Homolog Of SEQ ID NO. 287
MAPESLPLGIIPTVDMSAPCGELARRLVRACAERGFFKAVNHGVPPRVSARMDAAASAFFARPGQAKQAAGPPDPLGYGSRNIGANGDVGELEYLILHADPGAVARKAKVIDKDDPSRFSVAVNEYVGAVRHLACRVLDLLGEGLGLRDPTSLSRLISAVDSDSLLRINHYPTSRSSAADISTKGIGFGEHTDPQILSLLRANDVDGLQVLLPDGHGGGDEQWVQVPADPSAFFINVGDLLQALTNGRLVSIRHRVMASTTRPRLSTIYFAAPPLDARVAALPETVTAGAPRRYRTFTWAEYKKAMYALRLSHNRLDLFHATSGSSRDVIDDDHEQ

SEQ ID NO: 1267 - protein, 331 aa, Aspergillus oryzae 3.042
  misc_feature (1)..(331): Public GI ID no. 169781970
  misc_feature (1)..(331): Bit score of 24.6 for HMM based on sequences of FIGURE 5.
  misc_feature (39)..(56): Pfam Name: 2OG-FeII_Oxy Pfam Description: 2OG-Fe(II) oxygenase superfamily
  misc_feature (1)..(331): Functional Homolog Of SEQ ID NO. 287
MASTLKANVPKIDVSPLFGDNMEEKMKAARAIDAASRDTGFFYAINHGIDVNRLSQKTKEFHMSITDEEKWDLAIRAYNKEHQDQIRAGYYLSIPGKKAVESFCYLNPNFKSDHPRIQSKTPTHEVNVWPDETKHPGFREFAEQYYWDVFGLSTALLRGYALALGKEEDFFSRHFKKDDALSSVVLIRYPFLDPYPPAAIKTAADGTKLSFEWHEDVSLITVLYQSNVQNLQVETPQGYLDIEANDTGYLINCGSYMAHITNNYYPAPIHRVKWVNEERQSLPFFVNLGFDETIQPWDPRSPDGKTDKEPVSYGQYLQNGLVSLINKNGQT

SEQ ID NO: 1268 - protein, 360 aa, Brachypodium distachyon
  misc_feature (1)..(360): Public GI ID no. 357128523
  misc_feature (1)..(360): Bit score of 364.6 for HMM based on sequences of FIGURE 5.
  misc_feature (189)..(300): Pfam Name: 2OG-FeII_Oxy Pfam Description: 2OG-Fe(II) oxygenase superfamily
  misc_feature (1)..(360): Functional Homolog Of SEQ ID NO. 287
MAAITMTALPSSVDHQVVIPLLKCPIAAAAAAAMIPTVDLSSPGAARAVAEACRGVGFFRATNHGVPSSLAATLEADAMAFFALPDKDKQSTTTTTTPAPGPGSARPSLGYGSRRIGSNGDVGWLEYLILSLGSNSVLPASLRLALHEYTRAVRELSGRVLELMAEGLGIVGETERGVLRRMVAGSEEELVRVNHYPPPTTERDEDDDGCVGITGFGEHTDPQLISLLRSNRTAGYQILLQEADEARWVNVAPDPDSFFVNVGDTLQVLTNGRFRSVKHRVLVAPERGGKASRLSVIYFGGPAPAQRIAPLPELMREGERSLYRDFTWGEYKAAAYKTRLGDHRLGPFQVQLLPPAAAKA

SEQ ID NO: 1269 - protein, 317 aa, Lithospermum erythrorhizon
  misc_feature (1)..(317): Public GI ID no. 261363611
  misc_feature (1)..(317): Bit score of 126.3 for HMM based on sequences of FIGURE 5.
  misc_feature (48)..(65): Pfam Name: 2OG-FeII_Oxy Pfam Description: 2OG-Fe(II) oxygenase superfamily
  misc_feature (1)..(317): Functional Homolog Of SEQ ID NO. 287
MEAFPIINLEKLNGDERGATMEMIKDACEKWGFFELVNHGISHDLMDTVERLTKGHYKKSMEHRFKEMVASKGLDAVQAEINDLDWESTFFLKHLPLPNISEVPDLDDEYRETMRQFAKELEKLAEDLLDLLCENLGLEKGYLKNAFYGSKGPTFGTKVSNYPECPKPDLIKGLRAHTDAGGIILLFQDDKVSGLQLLKDDKWVDVPPMRHSIVINIGDQLEIITNGKYKSVMHRVVAQTDGARMSIASFYNPGGDAVIYPAPALLEKEAEEKVLYSGLKFVFEDYMKLYAGLKFQAKEPRFEAMKAIESVVPIPTV

SEQ ID NO: 1270 - protein, 345 aa, Glycine max
  misc_feature (1)..(345): Public GI ID no. 356528126
  misc_feature (1)..(345): Bit score of 522.6 for HMM based on sequences of FIGURE 5.
  misc_feature (176)..(285): Pfam Name: 2OG-FeII_Oxy Pfam Description: 2OG-Fe(II) oxygenase superfamily
  misc_feature (1)..(345): Functional Homolog Of SEQ ID NO. 287
MVVLSHQSALNELFLVKTCKSTFIGVPEVDLTHPEAKTTIVKACQEFGLFKVVNHGVPLELMTHLENEALKFFMQPQSLKDKAGPPDPYGYGSKRIGTNGDLGWVEYLLLNTNPDVISPKTLQLFEQNPEMFRCGVEEYIGAVKKICCEALELMADGLEIVPRNVFSRMIRDERSDSCFRMNRYPECPELKVEALSGRNLTGFGEHTDPQIISVLRSNNTSGLQICLPDGDGDGTTWASIQPDHTSFFINVGDLLQVMTNGSFKSVKHRVLVDSSMSRLSMIYFGGPPLNEKIAPLPSLVSREEESLYRELTWLEYKNAAYKSKLSDNRLSLFDKSADHSDKSPL

SEQ ID NO: 1271 - protein, 334 aa, Vitis vinifera
  misc_feature (1)..(334): Public GI ID no. 380448148
  misc_feature (1)..(334): Bit score of 559.4 for HMM based on sequences of FIGURE 5.
  misc_feature (177)..(280): Pfam Name: 2OG-FeII_Oxy Pfam Description: 2OG-Fe(II) oxygenase superfamily
  misc_feature (1)..(334): Functional Homolog Of SEQ ID NO. 287
MVVLSQNGRQQLPLIKACKPNYGFTGIPVIDMTSPHAKAHMVEACEEFGFFKLVNHGVPMEFMSRLEDEAIKFFSLPQSEKDLAGPPQPFGYGNRRIGPNGDVGWIEYLLLSTNPDSISQICSSISPENPEIFGSAVVDYVSSVKNMTYEVLEMIAEGLNIEPRNVLSRLLKDEDSDSCFRVNHYPPCPELEALRRPSFGWGFGEHTDPQIISVLRSDNTNGLEICLKDGTWVSVPSDQDSFFINVGDSLQVMTNGKFKSVKHRVVTESRKARVSMIYFGGPPLTEIIAPLPSLVKEGEETLYKEFTWADYKKSVYKSRLADNRLGLFEKKEQP

SEQ ID NO: 1272 - protein, 539 aa, Oryza sativa Indica Group
  misc_feature (1)..(539): Public GI ID no. 125525840
  misc_feature (1)..(539): Bit score of 175.4 for HMM based on sequences of FIGURE 5.
  misc_feature (387)..(485): Pfam Name: 2OG-FeII_Oxy Pfam Description: 2OG-Fe(II) oxygenase superfamily
  misc_feature (1)..(539): Functional Homolog Of SEQ ID NO. 287
MASLPVPSVQAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVESEVIAERWVGGVQSAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVEPEVIAERCVGGVQSVRVQYYPPCGQADKVVGISPHSDADLVTILLQANEVDGLQIRRGGAWLPVRPLEGALIVNVGDILQVFTNGRYKSVEHRVVVDGKKERLSMATFHSPSKNAIVGPLSEMVEHEDDAAYTSMNHDELLKLFFAKKLEGKNFLNPIKKLKNSG

SEQ ID NO: 1273 - protein, 343 aa, Triticum aestivum
  misc_feature (1)..(343): Public GI ID no. 327179111
  misc_feature (1)..(343): Bit score of 511.0 for HMM based on sequences of FIGURE 5.
  misc_feature (175)..(279): Pfam Name: 2OG-FeII_Oxy Pfam Description: 2OG-Fe(II) oxygenase superfamily
  misc_feature (1)..(343): Functional Homolog Of SEQ ID NO. 287
MVVLAKPAALEQIALLRTPEAWESFSGVPAVDLSGPGAAADVVRACERYGFFSVVNHGVPAGVVDRLEAEAVRFFASSQADKDASGPADPFGYGSKRIGRNGDMGWVEYLLLAIERDALSKASPAPTSALRDAINDYVGAMRGLARTVLEMVAEGLGVSPRGALADMVTGDAASDQVFRVNHYPPCPLLQGLPPNCSVTGFGEHTDPQLVSILHSNGTPGLQVALHDGRWVSVPPNRDAFFVNVGDSLQVLTNGRLRSVRHRVVAGNGLKSRMSMIYFGGPPLAQRIAPLPQLLAGTQSLPLYRDFTWGEYKKAAYRSRLGDNRLAPFEAPPVATPHADRHRS

SEQ ID NO: 1274 - protein, 388 aa, Gibberella intermedia
  misc_feature (1)..(388): Public GI ID no. 188037478
  misc_feature (98)..(368): Pfam Name: p450 Pfam Description: Cytochrome P450
  misc_feature (1)..(388): Bit score of 587.9 for HMM based on sequences of Figure 9
  misc_feature (1)..(388): in Figure 9
MKYTTCQMNIFPSLWSMKTSFRWPRTSKWSSVSLYDMMLRTVALLSGRAFVGLPLCRDEGWLQASIGYTVQCVSIRDQLFTWSPVLRPIIGPFLPSVRSVRRHLRFAAEIMAPLISQALQDEKQHRADTLLADQTEGRGTFISWLLRHLPEELRTPEQVGLDQMLVSFAAIHTTTMALTKVVWELVKRPEYIEPLRTEMQDVFGPDAVSPDICINKEALSRLHKLDSFIREVQRWCPSTFVTPSRRVMKSMTLSNGIKLQRGTSIAFPAHAIHMSEETPTFSPDFSSDFENPSPRIFDGFRYLNLRSIKGQGSQHQAATTGPDYLIFNHGKHACPGRFFAISEIKMILIELLAKYDFRLEDGKPGPELMRVGTETRLDTKAGLEMRRR

SEQ ID NO: 1275 - protein, 514 aa, Glomerella graminicola
  misc_feature (1)..(514): Public GI ID no. 310790427
  misc_feature (1)..(514): Glomerella graminicola M1.001
  misc_feature (129)..(481): Pfam Name: p450 Pfam Description: Cytochrome P450
  misc_feature (1)..(514): Bit score of 788.6 for HMM based on sequences of Figure 9
  misc_feature (1)..(514): Functional Homolog Of SEQ ID NO. 1274
  misc_feature (1)..(514): in Figure 9
MLWQIWLPVAVATAVLAVQRLRKKYKPSYDLPVVGSPTDQSMAEALVEGHQKYPESAFVVPSDPPRVVLPMNLYQEVIHAPESELSFGAEIYDIFLGKYTHLGEPRMEVVEAIRVDMTRNLSGILLPIQEEVKFAMKQMFGVLEDWKSFNAYHLVLRLVALMSGRVFVGLPLSRDEEWIQASITFATDCGKCRMAALEWNPWVRPWVLPFLPEVRHMRRTLQKANEWMRPLVDEVLRNESALEEKPAKPGAPGAFVSWMMKHTAPQKKTSENMGTNQMLLSFAAIHTTSSTATFALYDLLSRPEYIGPLREEIEQVIAQDGAEKDEDGQMFLSKVSLSKLKKLDSFIKESQRMNPLNFGGTSRRLQKDQTFSNGLKLPAGTPISFPLWGVYNSSSTNTFSDAYNEGTGNAPPTEFDGFRFARLREQPGRETKHQAATTGPDAFNFGHGPHACPGRFFAVYVIKCIFIEFLLNYDIRLKGSGGKDAGSRPPNTIRKMIVMPDFGREVEVRKRTGA

SEQ ID NO: 1276 - protein, 531 aa, Botryotinia fuckeliana
  misc_feature (1)..(531): Public GI ID no. 347831214
  misc_feature (162)..(496): Pfam Name: p450 Pfam Description: Cytochrome P450
  misc_feature (1)..(531): Bit score of 822.0 for HMM based on sequences of Figure 9
  misc_feature (1)..(531): Functional Homolog Of SEQ ID NO. 1274
  misc_feature (1)..(531): in Figure 9
MSPALFDKSKDMTMSPLFLGASALIVLAYVIKAILSRPQKLDLPIVGKPGADYWQEALLEGTTKYPNTPFVLPSDPPLVVLPHCTHEEVRTLTEEKVSFQEEVHRMFLSAHTKVGTDFPVVVKTVKTDLTRHSASTVGALEDETNYALDTEFGTGESWTKVVLFEKVVRIVALVSGRVFVGRPLSRNEEWLQASIQYTIDCAKARDAANEWPVWTRYFVVPFLPEIKKVKSHTVKAAELLKPLINQCIQRFKEGKGIGGESGDEFDDDQGTFVSWIMKHTSPELRENPYSLAINQLTLSFASIHTTTMAVCHILFDLASHPEFIAPLREEIEQVIAEDGFEVDGSGKKCLKKQSMAKLKKLDSLLKESQRVNPPGIIANSRITTAPLHLSTGHTIPKGTRIGYDAQVLNTAGPNLSLLPHDPSTMPQLDPPSVFSPFRFASIRETPGNESKYQFVTTSKEAMNFGHGNHACPGRFFAGVEIKVILIELLRGWDFRNVGDTEMKGGGRPENFCVDTAINPNPVAEIEFKRRV

SEQ ID NO: 1277 - protein, 531 aa, Sclerotinia sclerotiorum
  misc_feature (1)..(531): Public GI ID no. 156047892
  misc_feature (1)..(531): Sclerotinia sclerotiorum 1980 UF-70
  misc_feature (128)..(497): Pfam Name: p450 Pfam Description: Cytochrome P450
  misc_feature (1)..(531): Bit score of 804.1 for HMM based on sequences of Figure 9
  misc_feature (1)..(531): Functional Homolog Of SEQ ID NO. 1274
  misc_feature (1)..(531): in Figure 9
MSPPFLNESKGTTMSPVLLGASAFLLLAYVVRAILARPQKLDFPVVGKPGDANFEAALLEGTAKYPNTPYIIPSVPELVVLPMSTHDEMRNLPEDKASFMQDLSHVFFGKHTGIGENTPPLIKTIKADLTRHMASTVEALQDEARYALNEFGSCENWTKVDLTKAIPRMVALLSGRAFVGKPLSRNEEWINATVDYTVDTVKAKDEVLQYPALIQNLAVSFLSQIRTVKQHKSKVAKLLRPIIEECMRKFKEEKTADKESSDGFDDNQGSFISWLLKWTDEKSREDPFALADTQLMLSFAAIHTTSMALSHILYDIASHPEFIEPLREEIEQVIAEDGDEIDGSGSTNLKKQSFAKLKKLDSFMKESQRFSPPALVTNFRRTTSTLHLSTGHTIPKGTRICYDTVSVNMSNPDLSSIPHDPSNVTSLDPPTTFSPFRWSSLRDTPGNESKFQFVTTSKQSMNFGHGNHACPGRFFAGLELKVAIVELLRNWEFRLVGDEGAKGGERPKNLVYDVTIMPDPVGQLEFRRRKF

SEQ ID NO: 1278 - protein, 593 aa, Aspergillus nidulans
  misc_feature (1)..(593): Public GI ID no. 67522282
  misc_feature (1)..(593): Aspergillus nidulans FGSC A4
  misc_feature (133)..(559): Pfam Name: p450 Pfam Description: Cytochrome P450
  misc_feature (1)..(593): Bit score of 870.1 for HMM based on sequences of Figure 9
  misc_feature (1)..(593): Functional Homolog Of SEQ ID NO. 1274
  misc_feature (1)..(593): in Figure 9
MPRLSSLVIFSIASKKILIIFTGQKVLHLYWIILKDSRDDPLPTRRHHPSEGVVGLITDMDNYTWHSGTLIPSDSPSSIDRSQLYLEILGVLSVVYLLQTLVAYSKSFKAPFVGFRFWYEPKWLVGLRFSQGALAQVNEGYAKYKNAMFKVARNDSDILVIPNKYVEELRSLPDEKISAIRAHIKNLLGKYSTTLILLESDLHTRMLQTKLTPNLGSFIEVIESELLFAMDQEIPANLDDWQSVNVFHIVLRIVARISARVFLGVPACRNEEWLQTSIHYTENVFATVMLLRRFPKWMHPIVGHLLPSYWAIHRNLRTAKRIISPMVRQRRAEEAKRNPDYVKPNDLLQWMMDGANENDGQPDKLAHRQLLLSLASIHTTTMAAAHCFYDLCQHPEYFEPLREEINDVIAQDGGWKKTTLNKMRKLDSFLKESQRINPPSLLAFNRIVSEDLTLSDGTLLPKGTHFSMPSAAILQDNGVEPGADQFDGFRYYKKRLNPEEANKHQFAMTDNNNLHFGHGKYSCPGRFFASNEIKIIMAHLLTDYEFKYPRGATRPRNLTADENLYPDPSARLLMRRRVVAPPQASITPQLVSA

SEQ ID NO: 1279 - protein, 537 aa, Neosartorya fischeri
  misc_feature (1)..(537): Public GI ID no. 119494789
  misc_feature (1)..(537): Neosartorya fischeri NRRL 181
  misc_feature (67)..(505): Pfam Name: p450 Pfam Description: Cytochrome P450
  misc_feature (1)..(537): Bit score of 869.4 for HMM based on sequences of Figure 9
  misc_feature (1)..(537): Functional Homolog Of SEQ ID NO. 1274
  misc_feature (1)..(537): in Figure 9
MDNYTLLSLHTGNLKPPDSSSSIDRSQLYLGVIGVLSVIYLLQTLVACTKSFKAPFVGFRSSFEPKWLVGLRFSQGALAQVNEGYEKYKNAMFKIARNDSDILVIPNKYVEELRSLPDEKISAIRAHIKNLLGKYSTTLILLESDLHTRMLQTKLTPNLGSFIEVIESELHFAMEKEIPADLHDWQNVNVFHIVLRIVARISARVFLGVPACRNEEWLQTSIHYTENVFATVMLLRRFPKWMHPIVGHLLPSYWAIHSNLRTAKRIISPMVRQRRAEEAKGDPTYEKPNDLLQWMMDGANENDGQPDKLAHRQLLLSLASIHTTTMAAAHCFYDLCQHPEYFEPLREEINDVIAQDGGWKKTTLNKMRKLDSFLKESQRINPPSLLAFNRIVSEDLTLSDGTLLPKGTHFSMPSAAILQDNAVEPDADQFDAFRYYKKRLNPEEANKHQFAMTDNNNLHFGHGKYSCPGRFFASNEIKIIMAHLLTDYEFKYPPGASRPRNLTADENLYPDPSARLLMRRRMVAEGQAQITPEIVLV

SEQ ID NO: 1280 - protein, 513 aa, Penicillium marneffei
  misc_feature (1)..(513): Public GI ID no. 212539424
  misc_feature (1)..(513): Penicillium marneffei ATCC 18224
  misc_feature (145)..(492): Pfam Name: p450 Pfam Description: Cytochrome P450
  misc_feature (1)..(513): Bit score of 392.6 for HMM based on sequences of Figure 9
  misc_feature (1)..(513): Functional Homolog Of SEQ ID NO. 1274
MDLEFSLMLLTGVTIWSLFFSGPKKFNYPIYGAEDEKPSSLMRKFQHEADILLVDAYKKFRGGIFQLYTPDGVRLFLPRKYAQELKGYDREELSGMKALADVSAKVLSYKYKGSNTGQRHLGQYTTIDHESPYMLNAIKLDLNQKLGQFVTDVQNEVAHVIDATFPTCEDWTPVNLNNLLLRIISQVSARIFVGPSLNRNKEWLDLSEKFATDVMIGGEKLKGWRPILRPIAQYLIPEVRRIQADHEEAYQMLRPVLEARDRAEAELGYEYKKPNDMLEWIRTRATKNNDKSVDYREQANIQLLTATAAIHTTRLATLHVLFDLAARPEYIDPLREELREVLSETNGVLTKQTLTHLKKLDSFMKESQRHNPPSLATFQRKVLIPIKLSNGLELPVGVIVQCNTGVLDEVPESWGDPHAFDGFRFYRLRRKPEDAHKYQFPSISLESMEFGLGKDACPGRFFATNQIKIILAHLIFHYDIALEKPEAGRPKNFMFEVNVLADPTAKLLLKRRN

SEQ ID NO: 1281 - protein, 498 aa, Postia placenta
  misc_feature (1)..(498): Public GI ID no. 327343381
  misc_feature (33)..(472): Pfam Name: p450 Pfam Description: Cytochrome P450
  misc_feature (1)..(498): Bit score of 344.1 for HMM based on sequences of Figure 9
  misc_feature (1)..(498): Functional Homolog Of SEQ ID NO. 1274
MEDKAQYVFALLGILATLYFVRWSTDPLRHIPAIGPSAPIVSYLSAYRYCRNAQSILQEGYHKYKVFRVSLVDRWVVVVSGADMNEELRKVPDTHVSFQEAADDLIQLKYTIAPDVNEHPIHTPVIRGPLTRNLGALFPDVVDEINVAFPELMPPAAKRGDWVAVSVRDTMGRIVSRASNRIFVGLPLCRNPDYLKTVVEFAFSVAKSRTIINAAPAVFRPIVGHFLPWAKRAVRNAGVHVKPLIRLRVSKMQDAGDDQTDKSCDYLMWLIEEAQKTKQNLDIVVQGILVSNFAAIHTSSNSITHSLLNLAAYPQHVQPLREEIEGIIKEYGWTKEAIGKMWKLDSFMRESQRLSGISGISVMRKVLQDITLSDGTYLPKGTLVVAAAFATHTDERYYENPEVFEPFRFYDMRTENDALRKQYVNTSREFITFGHGKHACPGRFFAVNELKAMMAYIILHYDVKLEEGVSRPENVWIWHNISPASTKVLFRERQSKVQ

SEQ ID NO: 1282 - protein, 515 aa, Verticillium albo-atrum
  misc_feature (1)..(515): Public GI ID no. 302404826
  misc_feature (1)..(515): Verticillium albo-atrum VaMs.102
  misc_feature (193)..(506): Pfam Name: p450 Pfam Description: Cytochrome P450
  misc_feature (1)..(515): Bit score of 406.6 for HMM based on sequences of Figure 9
  misc_feature (1)..(515): Functional Homolog Of SEQ ID NO. 1274
MNESSEMASATDIVDFQLPRVVHGSKNLSYYVGLGAILCVAWFFQSKKHGQIDVPFYKAAKTKWIFAAESLILDSYNKFRDTIYQIRATEGVQVLVPAKYLPELKGLPEDVLSAQEAVSEALMTKYTKFGLGHNAEMLSTLIRVRLSQNLARLVPQLKGELESIVATEFPECNDWTPVRFQPFALRAISRISGRAFVGPSINRSEQWMDTSINFAIHVFTAVVKLQFFPEWSRPAAQYLVSELRQIRKDIDVAKKMLKPVIEERLRDMEMHSAEEKPDDLIQWLVEALPTEEKTDYEAQAHIQLVLAAASIHTTTNLVTDCMYDLAAHPEVQEMLREEAHQVLEVEEGWLRKESMAKLKKLDSFMKETQRLAGNITGFIRKVLKPITLSDGTRLPPGTKLLTPQAGISHDERFFADPETFDAMRFYKMRQASEEEGHRWQFSSIGDTNVNFGAGRHACPGRFFAGNEIKMVLAYFLLRYEVRLKEGEGRPKGMMMVMSKMPDPNAELLFRRRTVD

SEQ ID NO: 1283 - protein, 513 aa, Trichophyton equinum
  misc_feature (1)..(513): Public GI ID no. 326484980
  misc_feature (1)..(513): Trichophyton equinum CBS 127.97
  misc_feature (144)..(491): Pfam Name: p450 Pfam Description: Cytochrome P450
  misc_feature (1)..(513): Bit score of 384.7 for HMM based on sequences of Figure 9
  misc_feature (1)..(513): Functional Homolog Of SEQ ID NO. 1274
MFTQRQGVSALDEATLAFLVAVVVIGLSIVVLSGYHFLAAPNTRWIPRAGKAPGWFGLVNAKRDFIENGAKIIDQGYLKYKDSAFLVQTADMERIVLSPKYLHEIRTAPESILSLREGMSQRHLGKFTTLDVILTSHLQSSVCKTQLTQNLHALIAPMNEEAQFWLAQRIPIDQPSSTVLGHDTLLSVVAGISSRVLVGLPMGRDQDWLRTVVGYTIDVMQASAGLRPYPTLLRPLVAPWLGCIKRLQRHLDTAHRCFGDVFAQRLADPSRTEGEQNVIQWMAETATGDDRSPEVLVKKLLFITLAAVHTSTMAATHALFDLCVMPEYIPLLRKELDEVIAKHGWTLAAINNMPVLDSFLKESQRINHPGLLSFNRKVLQPLRLSDGTVIPAGSFISMATSSIARDPEHYPEPDRFDGLRFYNKRKASNGDSSKRHQFVSTGPENLAFGFGKFACPGRFFAAAQIKMIMATIILRYDVSFPDGQKTRPQNTFVGESIGPDRRQVIVFRRRSDV

SEQ ID NO: 1284 - protein, 503 aa, Trichoderma virens
  misc_feature (1)..(503): Public GI ID no. 358384361
  misc_feature (1)..(503): Trichoderma virens Gv29-8
  misc_feature (195)..(482): Pfam Name: p450 Pfam Description: Cytochrome P450
  misc_feature (1)..(503): Bit score of 392.2 for HMM based on sequences of Figure 9
  misc_feature (1)..(503): Functional Homolog Of SEQ ID NO. 1274
MLASLPLDQGLTPVALISTASVALVCLVLYRRRSGAADLHSLGIPVFDSRDDDNGIVATLERANKLHPNAPFALAVPGQQLVVLPVSEIDTVKAQPETQLSIKKHHYNQFLGEYSYMGTRADEFDNAMRNTLVRNTPTVLRAFTAEIDYATRVTIGDKLPTWTKIKPRGIMARMATILSGRSFVGLPLSRDEEWINATVGFTGDVSKAWMVLRFIPHFLRPFIAPFLSQVRSLEGCKALITRKLNGLLQEREKKQDSEKPAGDDEVGGELLDWFRSQYSHKPTVKELARDQLLATFASIYNLTNALTYVVFDLASHPEYIEELRAELQEVVGEDGVINKTTIMQLVKLDSFVRESQRLRPTSLVNIPRVVTAPKGLKLTTGHIIPPGFLVMVRAQPINLSPTLYPEPEKFDAFRFAKMRAQPGNEMKFQHTSTGTDNINFGHGIWACPGRFFASAQVKVVAAHLIRNFDIRLPEGKEKPVPQYGGLAIFPDAVAEIELRSRKL

SEQ ID NO: 1285 - protein, 507 aa, Talaromyces stipitatus
  misc_feature (1)..(507): Public GI ID no. 242804557
  misc_feature (1)..(507): Talaromyces stipitatus ATCC 10500
  misc_feature (166)..(478): Pfam Name: p450 Pfam Description: Cytochrome P450
  misc_feature (1)..(507): Bit score of 417.1 for HMM based on sequences of Figure 9
  misc_feature (1)..(507): Functional Homolog Of SEQ ID NO. 1274
MDLENSLVSTFGALALTTVLLAGVIIWSLFFTGPKTFNYPIYGAEGEKPSTLMRKFQHQADILLVDAYKKFRGGIFQLYTPDGVRLFLPRKYAQELKGYNREELSGMKALADRHLGQYTTIDHESPYMLNAIKLDLNQKLGQFVTDVQNEVAQVINTTFPACEDWTPVNLNDLLLRIISQASARIFVGPSLNRSKEWLDLSEKFATDVMIGGEKLKGWRPILRPIAQYLIPEVRRIQADHEEAYQMLRPVLEAREKEEAEKGDHYERPNDMLEWIRTRATKNNDKSVDYREQAKIQLLTATAAIHTTRLATLHVLFDLAARPEYIDPLREELQQVLAETDGPLTKQTLTHLKKLDSFMKESQRHNPPSLATFQRKVLTPVKLSNGLELPRGVIVQCNTGVLDEVPESWGDPHAFDGFRFYKLRSKPEDAHKYQFASISLESMEFGLGKDACPGRFFATNQIKIILAHLILYYDLALEKPDLGRPKNFMFEVNVLADPTARLLLKRRA

SEQ ID NO: 1286 - protein, 515 aa, Verticillium dahliae
  misc_feature (1)..(515): Public GI ID no. 346979790
  misc_feature (1)..(515): Verticillium dahliae VdLs.17
  misc_feature (189)..(495): Pfam Name: p450 Pfam Description: Cytochrome P450
  misc_feature (1)..(515): Bit score of 409.3 for HMM based on sequences of Figure 9
  misc_feature (1)..(515): Functional Homolog Of SEQ ID NO. 1274
MNESSEMVSAADIVDFQLPRVVHGSKNLSYYVGLGAILCVAWFFQSRKHKQIDVPYYKAAKTKWIFAAESLVLDSYNKFRDTIYQIRATEGVQVLVPAKYLPELKGLPEDVLSAQEAVSEALMTKYTKFGLGHNAEMLSTLIRVRLSQNLARLVPQLKGELESIVATEFPECNDWMSVKFQPFALRAISRISGRAFVGPSINRSEQWMDTSINFAIHVFTAVVKLQFFPEWSRPAAQYLVSELRQIRKDIDVAKKMLKPVIEERLRDMEMHSAEEKPDDLIQWLVEALPAEEKTDYEAQAHIQLVLAAASIHTTTNLVTDCMYDLAAHPEIQEMLREEAHQVLEVEEGWLRKESMAKLKKLDSFMKETQRLAGNITGFIRKVLKPITLSDGTRLPPGTKLLTPQAGISHDERFFADPETFDALRFYKMRQASEEEGHRWQFSSIGDTNVNFGAGRHACPGRFFAGNEIKMVLAYFLLKYEVRLKDGEGRPKGMMMVMSKMPDANAELLFRRRTVD

SEQ ID NO: 1287 - protein, 524 aa, Uncinocarpus reesii
  misc_feature (1)..(524): Public GI ID no. 258578343
  misc_feature (1)..(524): Uncinocarpus reesii 1704
  misc_feature (242)..(500): Pfam Name: p450 Pfam Description: Cytochrome P450
  misc_feature (1)..(524): Bit score of 529.8 for HMM based on sequences of Figure 9
  misc_feature (1)..(524): Functional Homolog Of SEQ ID NO. 1274
MPLFENTLLRNMQSTLNDTWLKLSCQKPAVFVFGVTVFLSWQLVNRIFFSVKAPYAGYESSWEPIWLISRRCSHEAPRLIQEGYRRYRDAMFKIAKRNSDLLVIPKKFVEELRSLPEEQICAMEAHIRTLLGPITGTDILLNGHLHNKALQTRLTPNLGSLVQPLKDELDYAISVELPNCKDEWVEVQMHGIVRRLVARLSARAFTGPVACRDEDWVMTNTMYPANVFTTIGPLRLFPSFMRSTVALFLPSYWQLRSNFATANRVLVPIILQRRRDEASGDLNYEKPKDLLQWLMDLAEPNEAAPHLLAHRQLALSLGSLNTTTTAAVQTLYDICDHPEYLESLRTEVLGALTADGGWDRTTITKLVGLDSFMKESQRVNPPSYVSFNRVVRKSLTLSDGTRLPKGTHFGMASYSILQDPAIIENPHEFDGFRYKRIREDPKEANKHQFASTDSNNIHFGHGKYACPGRFFASQIVKMIIGHLILKFDFKFPEGQGRPRNLSIDENVYPDPSARLMMRRRQMVY

SEQ ID NO: 1288 - protein, 494 aa, Trichophyton equinum
  misc_feature (1)..(494): Public GI ID no. 326483893
  misc_feature (1)..(494): Trichophyton equinum CBS 127.97
  misc_feature (116)..(485): Pfam Name: p450 Pfam Description: Cytochrome P450
  misc_feature (1)..(494): Bit score of 405.0 for HMM based on sequences of Figure 9
  misc_feature (1)..(494): Functional Homolog Of SEQ ID NO. 1274
MAGLLEGYPAAHLGLVVLLLVGVLWLCLKVAPSTRKVPATGFPVIKLKSNDMEPGLIEGSKLYPDQPYEIQVPAKQMIILPRKYLDEIKRFPESQMSFKALVKDAMAGEYTLIATHDHSLVTALRRDLTQNIVHALELLQEEAVSVVKNKLEFCGNDYAPVKLLPTLLDMVSSMTSRVLVGLPLCHNKEWLGCILKYTEDAFKAGMILHMTPSIIHPLLSALLPQLWAVRRHYATVKRLLKPVLEERIEKLKDPAYKPPRDIIQSFIDINPQKGMSLDFQATNQLMAAFTSMHTTSMNACHALFHLAAAPEHVAPLREEIETVLAEEGNITSKAAMLKLRKLDSFIRETQRLNPSSFVGMERKVLVTTKLSDGTVLPAGSIFGFNSFHINYDTRLWENPEKFDGFRFERLRAAEGNDHKYQATSIGLESLSFGLGTHACPGRFFAINETKILLAHLITNYDWAFPDGQGRPKNFTLISALIINPESEVLCRRRQ

SEQ ID NO: 1289 - protein, 499 aa, Penicillium marneffei
  misc_feature (1)..(499): Public GI ID no. 212542733
  misc_feature (1)..(499): Penicillium marneffei ATCC 18224
  misc_feature (225)..(489): Pfam Name: p450 Pfam Description: Cytochrome P450
  misc_feature (1)..(499): Bit score of 402.5 for HMM based on sequences of Figure 9
  misc_feature (1)..(499): Functional Homolog Of SEQ ID NO. 1274
MYPEALRSFDAATLGVLAATVALISIVNFMIFRRRNIDGPLFAVSPQGRSGFHSVSEVLEYTYPKFQDRVYRLRQHYGDIVVIPAKFVEALQAAPESLLSFQFLARERFFARYTLLVSMVDHPDNNTLIKSIKNNLNKSLGDILPTLDDEVQFAMSTHVGDANDWKAVFPAHSLLPVIASCSGRVFVGKDLNRNPEFLDCILNFTIDSMMGGEKLRQYPSFIRNFVQWWIPELQRSRAKLKKMMHLLGPVLEVRKGVDHVSDMLSWNVANSPSNLKHNLKYQAHNQLIASAAAIHTTNMQLSHALFDLAAYPEYQAPLREEVQTVLRTEPNGVWTKSGLAKLRKLDSFLKESQRMNPLGLLTFERRVMNDITLPDGVTIPKGYNIGCPTSSIAKDSALWDNPNTFEAFRFERLRQQPGCENKHQFVTTGIDSLYFGHGKHACPGRFLADAEIKLILINLILHYDCKLPDGTSRPANVEMNSGVMADPTKTILLKRRSNA

SEQ ID NO: 1290 - protein, 500 aa, Myceliophthora thermophila
  misc_feature (1)..(500): Public GI ID no. 367032834
  misc_feature (1)..(500): Myceliophthora thermophila ATCC 42464
  misc_feature (136)..(482): Pfam Name: p450 Pfam Description: Cytochrome P450
  misc_feature (1)..(500): Bit score of 393.5 for HMM based on sequences of Figure 9
  misc_feature (1)..(500): Functional Homolog Of SEQ ID NO. 1274
MPGLQVEAILDAIGARLSPILPTLAALVAVVLLQHVLSRGPLANIPLVGQELGGDEKRRQAYLSKAGDLYLEGYRKFTVVVVPPKYLGELRKLPDDVVDFDQAIAQTMHAKYTKIPIGQPLIPHTIKASLTPALVRINPTIASEVQLSIRKELPPCDDWTSININRKLLRIVALVSGRVFIGEELSRSQEYLDAAINYTVELMDARRAIERLRAWQRPFLANRLPEVKKLDQRLAQADRFLRPIVAARRQLQDSEKPNDMLQWIMDGQDKFRQYSTEELARLQLALSFAAIHTTSLTATNVFYNLAAYPHYIPELRDEIRSVLAEHDGVFTSPALQAMKKVDSFVKETMRLYPTGFAGFQRKVTKTFTLSNGQVIPAGVVIQVPADAIARDPEVFPNADQFDPWRFSRLREEARRAGKAEEAAHHQFVSVSPEVLTFGYGRHACPGRFFAANEIKMIIANFILAYDMKLPDGVTERYPNLTFGSTCVPDPRKELLFKRLA

SEQ ID NO: 1291 - protein, 493 aa, Trichophyton tonsurans
  misc_feature (1)..(493): Public GI ID no. 326470143
  misc_feature (1)..(493): Trichophyton tonsurans CBS 112818
  misc_feature (116)..(484): Pfam Name: p450 Pfam Description: Cytochrome P450
  misc_feature (1)..(493): Bit score of 400.2 for HMM based on sequences of Figure 9
  misc_feature (1)..(493): Functional Homolog Of SEQ ID NO. 1274
MAGLLEGYPAAHLGLVVLLLVGVLWLCLKVAPSTRKVPATGFPVIKLKSNDMEPGLIEGSKLYPDQPYEIQVPAKQMIILPRKYLDEIKRFPESQMSFKALVKDAMAGEYTLIATHDHSLVTALRRDLTQNIVHALELLQEEAVSVVKNKLEFCGNDYAPVKLLPTLLDMVSSMTSRVLVGLPLCHNKEWLGCILKYTEDAFKAGMILHMTPSIIHPLLSALLPQLWAVRRHYATVKRLLKPVLEERIEKLKDPAYKPPRDIIQSFIDINPQKGMSLDFQATNQLMAAFTSMHTTSMNACHALFHLAAAPEHVAPLREEIETVLAEGNITSKAAMLKLRKLDSFIRETQRLNPSSFVGMERKVLVTTKLSDGTVLPAGSIFGFNSFHINYDTRLWENPEKFDGFRFERLRAAEGNDHKYQATSIGLESLSFGLGTHACPGRFFAINETKILLAHLITNYDWAFPDGQGRPKNFTLISALIINPESEVLCRRRQ

SEQ ID NO: 1292 - protein, 409 aa, Neurospora crassa
  misc_feature (1)..(409): Public GI ID no. 164428375
  misc_feature (1)..(409): Neurospora crassa OR74A
  misc_feature (54)..(386): Pfam Name: p450 Pfam Description: Cytochrome P450
  misc_feature (1)..(409): Bit score of 307.5 for HMM based on sequences of Figure 9
  misc_feature (1)..(409): Functional Homolog Of SEQ ID NO. 1274
MHTKYTLIPTHEPILPHTIKTSLTPSLPRLNPQLSEEVQIAFSQEIAPLMSSSPSDWAPININSKLLRIVAKVSGRVFIGPELCHDERYLEAAVGYTVSVMEAQRAVERMNPWVRPIAAWRLKEVRKLAQMERDATAFLRPVVEARREKQRKGEEKDNDMLQWLMDSADQGQGKQHGKWGEDTTTTRKLARLQLAISFAAIHTTTLVTTHAVYSLAADPKLQATLREEIQSVLQEHKGVFNTSALQAMKKTDSFLKETMRFHPLGQTSFNRKVLRTFALSNGQVIPKGSTIEVPNYAVSRDPEAYPNPDVFDPLRFYNLRNEAREKGEAEQAASGQFVSVNKEFLTFGYGRHACPGRFFAANEIKMILANLVMTYEMGLVEGETERYRDWDIAAGTIPDPTKDVMFRKL

SEQ ID NO: 1293 - protein, 517 aa, Fusarium oxysporum
  misc_feature (1)..(517): Public GI ID no. 342886866
  misc_feature (1)..(517): Fusarium oxysporum Fo5176
  misc_feature (226)..(495): Pfam Name: p450 Pfam Description: Cytochrome P450
  misc_feature (1)..(517): Bit score of 389.2 for HMM based on sequences of Figure 9
  misc_feature (1)..(517): Functional Homolog Of SEQ ID NO. 1274
MENVSSLAASPIGVDYQLPQFVSEGHCTGYYITITIFLIAIWFFLPKKQTSHLEIPFYKASKTKWIFDAETLIKDSYTKFRDRVYQIKATEGVQVIVPARLVGELKGLPEDILSATEAVSDALQSKYTKFSPGHNGELLALLVRTKLTQNLTRVVPLLKKELEHLLATEFPICEDWTPVKWQPFSLRAVARLSGRAFVGPSINRDEKWMDTSINFAVHVFTACVKLQFIPEWARPVGQHLVSELRQIRKDIKIAKEMLKPILEERLRDMEFSNGGNAPDDMIQWLIEALPEEEKADLTTQAELQLIIAAASIHTTNNLLCECLCDLAAYPEVQEELREEAYRVLEVDNGWENKESMAKLKKLDSFMREVQRLSGNITSFIRKVMKPISLSDGTELPVGTKVLAPQAGIALDERYFPDPERFDAFRFYKLRQESAEASNRWQFTSLNDTYINFGAGKHACPGRFFASNEIKLVLAHLLINYDIRLKAGEDRPKAMSVVMAKAPSPDTELEFRRRSWAA

SEQ ID NO: 1294 - protein, 525 aa, Alternaria brassicicola
  misc_feature (143)..(494): GI:270124461
  misc_feature (143)..(494): Pfam Name: p450 Pfam Description: Cytochrome P450
  misc_feature (1)..(525): Bit score of 315.5 for HMM based on sequences of Figure 9
  misc_feature (1)..(525): Functional Homolog Of SEQ ID NO. 1274
MESAQIHSTRDSLFILWLTTLLVSVLATAAYIKFQSRPRPYSGFPLVTLGGPSETDSSHAANWFRRGRALVNKGLSELSGAFQISNGSGYWIILPSKYMDELRNHPDMSLRDALREENFPNYRGFDGFRQAFKDSTFTQEVIRVKVTQSLGLITANLANECQHALQENLGESREWQQRFIIEDILNIVAQLTSRVFLGERLCRDKEWLQITKEYARNSFMGSEELRQCLPLTRPLMQFFMPACTQLRKFSAAARRLIDPEVQARKRRAEEAIKLGKKPPKVEDTIGWMVEVARGRQVDYVGGQLALSIAAIHSSTDNLSKAVVKLCEMPEIVAPLREEITTVLESTDGWSKPALYRMKLLDSFLKEVQRLAPFTIVGMHRRVMKGYVLSDGTHLPKNSRIMVMNDKLRDSSVYEDPDTFKYDRFARLREQPGQEDQHQLASTSSEFATFGHGEHACPGRFFAANQLKIIMACLLLKYDFCFQPGQAEKARVIPFEMVETIDPTLKIEVRRRSEELDVTKVAKETA

SEQ ID NO: 1295 - protein, 497 aa, Coprinopsis cinerea
  misc_feature (1)..(497): Public GI ID no. 299744611
  misc_feature (1)..(497): Coprinopsis cinerea okayama7#130
  misc_feature (172)..(474): Pfam Name: p450 Pfam Description: Cytochrome P450
  misc_feature (1)..(497): Bit score of 307.6 for HMM based on sequences of Figure 9
  misc_feature (1)..(497): Functional Homolog Of SEQ ID NO. 1274
MDSVWQGLEAAKELVLERPGTAAASLGALYAAWLVYHLGDTRKVNHIPSLASNSAILSYLDGIKFFARAPQYAAESYEKLRSQVIKVPGLFNWIVLVHGHDLVEQVRKAPDHQLDFHIAVTESLQTPLTMGPAIESNPYHIGVVRNQLKRFTPQLIPAVHDEIANWASVVAHDEIMKVICRASNRTFVGLPVCRDPDYIDLNIKYTIDVVTSAAVLRLFPPFLRKTVHSVFLPATRKRVEQGVRHLAPLIKHRREQIALLGDEYERPMDFLMWLMEEAKGEETAERALTLRILVLNFAAIHTSTMTFTQALYDLAAHPEYQEPLREEARAAVKEHGWSKTAVDKFVKIDSFIKESQRHHPMASVMMNRHVLEDFTLANGVKVPKGLTLAVDITGMHQSSEYGNPSEFDPWRFSRIQEAGKRSDMTTTNAEFLAFGHGRHACPGRFFAAVELKLMMAYVVLNYDVKCEGERPKNLWLGVTCAPNPKAKLLFRKREPGI

SEQ ID NO: 1296 - protein, 523 aa, Coccidioides posadasii
  misc_feature (1)..(523): Public GI ID no. 320036821
  misc_feature (1)..(523): Coccidioides posadasii str. Silveira
  misc_feature (240)..(502): Pfam Name: p450 Pfam Description: Cytochrome P450
  misc_feature (1)..(523): Bit score of 542.1 for HMM based on sequences of Figure 9
  misc_feature (1)..(523): Functional Homolog Of SEQ ID NO. 1274
MFSLDPVFLNNAHILFHNALFTLSSNKPAIFVISAAVLFLWRLLKDILFSVKAPYVGYESSWEPTWLISRRFSREAPGLIEYGYQRYRDSIYKLSRRDSDILVIPHKFVDELRSLPEEHICAMEAHIQTLLGPITGTDILLDGDLHTKVLQTKLTPNLGHLIGPLKEELEFAMSMELPDCKDEWVEIQMHGIIRRFVARLSARAFTGPIACRNEEWVAANTAYPTNIFTTIGPLRMFPSFMRSSVAPFLSSYWRIRSNIATAKRVIVPIINQRRRDEASGDPNYEKPKDLLQWMLDTAKPKDAAPASLAHRLLALSLGSLNTTTTAAVQTLYDICNHPEYFEPLREELLDSLTANGGWDKATLSKLHGFDSFMKESQRVNPPSYLSFNRVVRKPLTLSDGTRFPKGTHFGMPAYSILQDPSIVENPTKFDGFRYKKIRQQPKEANKHQYASTDSNNIHFGHGKYACPGRFYASHVVKLIVGHLILEYDFKFPEGKCRPRNLNIDENVYPDPSATLLIRRRQMA

SEQ ID NO: 1297 - protein, 499 aa, Postia placenta
  misc_feature (1)..(499): Public GI ID no. 327343267
  misc_feature (209)..(494): Pfam Name: p450 Pfam Description: Cytochrome P450
  misc_feature (1)..(499): Bit score of 360.7 for HMM based on sequences of Figure 9
  misc_feature (1)..(499): Functional Homolog Of SEQ ID NO. 1274
MSGSVATYALLALPVLYVLVTLFVPPQRNLRHIPTVGGPSNPFLAWIGALRYVSHSAEILREGYAKYKGGVFKHAEPGGWCVVVTGSRKIEELHRAADDELSFIAATNETLQVPYTLGPNVASNLYHVPIVRSQLTRALPVLFPELRDEIVCAFGDAVGMPEEWKAVPAMEVVMDVVARTSNRLFVGLPLCRNADYCELNKQFTIDVFTGAAIINLFPSVLKPIARRLLTKVPQRIARGMKHLQPMIEERFHLIEAHGNDWPDKPNDLLQWLMDAAQGEERTMRALVLRVLTVNIAAIHTSSLTFINALYLLAAYPQYIAPLRAEVEAVVESEGWTKAAMNKMRKVDSFLKESNRYTGLGAKSMTRLALKDFTFSDGTFIPAGTTISAPAHAVHFDEDIWPNADVFDPFRFSSLREEEGEGAKHQMVSTSLDYIPFGHGRHACPGRFFAANELKAMLAHVAVTYDVKMEKDGVLPPSMWFGTALVPNRKAQVLFRKRKA

SEQ ID NO: 1298 - protein, 512 aa, Nectria haematococca
  misc_feature (1)..(512): Public GI ID no. 302890139
  misc_feature (1)..(512): Nectria haematococca mpVI 77-13-4
  misc_feature (142)..(502): Pfam Name: p450 Pfam Description: Cytochrome P450
  misc_feature (1)..(512): Bit score of 390.1 for HMM based on sequences of Figure 9
  misc_feature (1)..(512): Functional Homolog Of SEQ ID NO. 1274
MGNIQSFVDLAVNRWPTLLAIVVVCLTAAFGPTINRTILLRSLPVVGDGNAEKRRMAYLAGARKLYSDGYQKFKDGVFTITTSRTSPIVVISPKFLPELHKLPDSVVSMDAAVDETMETKYTKIETSVPIIPHTIKGDLTPSLNRLNPTIAQEVREALQLSIPSCDDWTEVNIHHSLLRIVGMVSGRVFIGPELCKSEKYLDAAINYTMEVMGAQRAVQQMRPWLRPFLASRLPAVKRLDQRIAEAEEFLNPIVKQRAEAIADPSAEKPDDMLEWLMNRKDKFPDKNSQNLAKVQLGLTFAAIHTTTLTATNAFYDLAAMPDVQKELRVEIREALSQTSGVFTSQALQNMKKMDSFLKEVLRLHPATMASFQRKVLKPFTLSNGQKIPEGVTIEIPAVAISADSSVFPKADKFDPWRFYRLRQQAKDDGSAEKAALHQFVSVNQSSLTFGFGRHACPGRFFAANEIKMILANTILQYDIKLVDATERYPNIEFAHMSIPDPSRKLLFKAIDV

SEQ ID NO: 1299 - protein, 495 aa, Arthroderma gypseum
  misc_feature (1)..(495): Public GI ID no. 315039401
  misc_feature (1)..(495): Arthroderma gypseum CBS 118893
  misc_feature (162)..(484): Pfam Name: p450 Pfam Description: Cytochrome P450
  misc_feature (1)..(495): Bit score of 499.3 for HMM based on sequences of Figure 9
  misc_feature (1)..(495): Functional Homolog Of SEQ ID NO. 1274
MDAGLVYKTLTSPAAVAGGICLAAAIYLCYPYVLPRKQALKFPVVLVEDGGMDNRTAVEYGYSKYPDQPFVLQSKTRTLVLLPPKYFDEIRSIPESKWSGRLSARNLFQSRYTRIGDNSHQVVHTVKTDLTRHIGKTLDALQDEMEYAAEQAIGACEDWTPIVPYPALLRIVSLISGRVLVGLPFSRTEQWIQISINFTMLCFGAAQKYATYSSWLRPFVVPFLDVTSNIHKQRKAATALLAPVITEYKNSMKSDEEPTNMIQWALASAKDDSMTAEEQADIQLTLSMAAIHTTSTTVLYCLYDLCTHPECIEPLREEIKTVLAETNGRLVKRNMAKLRKLDSFIKESQRLSPPGLVAMQRIVVSDITLSDGSFLPKGTAVGVPNWGVTRDDQLWTNPETFDGFRFAKLRDEAGAEHKHQFATSGPDSLSFGYGPQACPGRFFASNEIKVLLAHLLLNYDFKMEADRPQNIIHELTVMPNRGVNILFKKRVQAEQ

SEQ ID NO: 1300 - protein, 525 aa, Gibberella intermedia
  misc_feature (1)..(525): Public GI ID no. 74691493
  misc_feature (91)..(513): Pfam Name: p450 Pfam Description: Cytochrome P450
  misc_feature (1)..(525): Bit score of 451.5 for HMM based on sequences of Figure 9
  misc_feature (1)..(525): Functional Homolog Of SEQ ID NO. 1274
MNKSNSMNNTSLERLFQQLVLGLDGIPLMDVHWLIYVAFGAWLCSYVIHVLSSSSTVKVPVVGYRSVFEPTWLLRLRFVWEGGSIIGQGYNKFKDSIFQVRKLGTDIVIIPPNFIDEVRKLSQDKTRSVEPFINDFAGQYTRGMVFLQSDLQNRVIQQRLTPKLVSLTKVMKEELDYALTKEIPDMKDDEWVEVDISSIMVRLISRISARVFLGPEHCRNQEWLTNTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCARPEYIEPLRDEVKGVVDASGWDKTALNRLHRLDSFLKESQRFNPVFLLTFNRIYHQSMTLSDGTNLPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 1301 - protein, 523 aa, Aspergillus niger
  misc_feature (1)..(523): Public GI ID no. 350631590
  misc_feature (1)..(523): Aspergillus niger ATCC 1015
  misc_feature (146)..(502): Pfam Name: p450 Pfam Description: Cytochrome P450
  misc_feature (1)..(523): Bit score of 467.4 for HMM based on sequences of Figure 9
  misc_feature (1)..(523): Functional Homolog Of SEQ ID NO. 1274
MNKAETPSDSFSELHLIAAIGLSPALVGLLLGIYSLWYLVGPALKQHNTSNQPPIVGCRSRWEPTWLVRLRFIRGSRKIIGEGYERFKDTMFQVRRVGTDVLLVSSKYMDEIRTLTRDATGSVPPLVQDYPGEYTHGMPFLRSDLQNRVLQQKLTPNLPSLVPVMVEELEFAMRMEMPECAADDWTTVDIMPILSRIITRITSRIFLGPKEGRNEEWLVATVEYTRNFFLTGMALRFFPRFLRPLVAPLLPSYHHLWQNVATSRRIVGEIVRERREIEAAKPADYTKPADILQWMMDAATGQEAEPGDLAQRMLILSVTSIHTTTLTMTQAIYDLCAHPQYLEPLRAEVEDVLCTDGGWGKLTVNHLRKMDSLLKESQRFNPVFLLTFNRILPKSITLSNGVSIPVGSRIAVPSNAMLNDPSRVPGDAPTSFDAFRYSRLREEPENAQRHLFVMTDHNNLAFGYGKFACPGRFYAANEMKMMLAHMLICYDMRFPDGRGRPRNFTIDSDMYPDPATRLLIRKR

SEQ ID NO: 1302 - protein, 522 aa, Gibberella zeae
  misc_feature (1)..(522): Public GI ID no. 46109972
  misc_feature (1)..(522): Gibberella zeae PH-1
  misc_feature (233)..(501): Pfam Name: p450 Pfam Description: Cytochrome P450
  misc_feature (1)..(522): Bit score of 378.1 for HMM based on sequences of Figure 9
  misc_feature (1)..(522): Functional Homolog Of SEQ ID NO. 1274
MQNTSSLPASPVGVNVQYPQLVLEGKRTGYYITFTLFILTLWLILPKKQRSQLEVPFYKASKKNWIFDAETLIKDSYTKFRDRVYQIKATEGVQVLVPASLVGELKGLPEDVLSATEAVSDALQSKYTKFSPGHNGETLALLIRTKLTQNLTRVVPRLREELEYILATEFPACEDWTPVKWQPFSLRAITRLSGRAFVGPSLNRDEKWMDTTINFAVHVFTACVKLQFIPEWARPVGQYFVSELRQIRKDIKIAKELLEPILKERLQNMELSNGEDAPDDMIQWLLEALPKDEKSDLTTQAELQLIIAAASIHTTNNLLCECLCDLAAYPEVQEELRQEAYQILEAENGWERKESLAKLKKLDSFMREVQRLSGNITNQYAASFIRKVMKPISLSDGTQLPAGTKVLAPQAGIALDERYFPDPERFDAFRFYKLRQESSEANHRWQFTSLDDTYTNFGAGKHACPGRFFANNEMKLVLAHLLINYDIRLKPGQDRPKPMTVVMAKAPSPDTELEFRRRSLVA

SEQ ID NO: 1303 - protein, 529 aa, Arthroderma benhamiae
  misc_feature (1)..(529): Public GI ID no. 302502806
  misc_feature (1)..(529): Arthroderma benhamiae CBS 112371
  misc_feature (211)..(507): Pfam Name: p450 Pfam Description: Cytochrome P450
  misc_feature (1)..(529): Bit score of 338.5 for HMM based on sequences of Figure 9
  misc_feature (1)..(529): Functional Homolog Of SEQ ID NO. 1274
MFTQRQGVSALDEATLAFLAALVVIGLSIVVLSGYHFLAAPNTRWIPRAGKAPGWFGLANAKRDFIENGAKIIDQGYLKYKKDSAFLVQTADMERIVLSPKYLHEIRTAPESVLSLREGMSQVGNLLTDKRVSLTSFDLQLTGFIYTEAPGQIHDTGCDPDEPPAKQYALTTPMHEEAQFWLAQRIPIDKPSSAVLGHDTLLGVVAGISSRVLVGLPMGRDQDWLRTVVGYTIDVMQASAGLRPYPTLLRPLVAPWLGCIKRLQRHLDTAHRCFGNVFAQRLADPSRTEGEQNVIQWMAEAATGDDRNPEVLVKKLLFITLAAVHTSTMAATHALFDLCVMPEYIPLLRKELDEVIAKHGWTLAAINNMPVLDSFLKESQRINHPGLLSFNRKVLQPLRLSDGTVIPAGSFISMATSSIARDPEHYPEPERFDGLRFYNMRKASNGDSSKRHQFVSTGPENLAFGFGKFACPGRFFAAAQIKVIMATIILRYDVSFPDGQKTRPQNTFVGESIGPDRRQVIVFRRRSDV

SEQ ID NO: 1304 - protein, 513 aa, Trichophyton rubrum
  misc_feature (1)..(513): Public GI ID no. 327292707
  misc_feature (1)..(513): Trichophyton rubrum CBS 118892
  misc_feature (99)..(491): Pfam Name: p450 Pfam Description: Cytochrome P450
  misc_feature (1)..(513): Bit score of 382.1 for HMM based on sequences of Figure 9
  misc_feature (1)..(513): Functional Homolog Of SEQ ID NO. 1274
MFAQRQGVSALDDAILAFLAGVVVIGLSSVVLSGYHFLSAPNTRRIPRAGKAPGWFGLANAKRDFIANGAKIIDQGYRKYKDSAFLVQTADMERIVLSPKYLHEIRNAPESVLSLREGMSQRHLGKFTTLDVILTSHLQSSVCKTQLTQNLHALITPMNEEAQFWLAQRIPIDRPSSAVLGHDTLLGVVAGISSRVLVGLPMGRDQDWLRTVVGYTIDVMQASAGLRPYPTLLRPLVAPWLRCIKRLQGHLDTAHRCFGDVFAQRLADPSRTEGEQNVIQWMAEAATGDDRNPEVLVKKLLFITLAAVHTSTMAATHALFDLCVMPEYIPLLREELDEVIAKHGWTLAAINNMPVLDSFLKESQRINHPGLLSFNRKVLQPLRLSDGTVIPAGSFISMATSSIARDPEHYPEPERFDGLRFYNMRKASNGDSSKRHQFVSTGPENLAFGFGKFACPGRFFAAAQIKVIMATIILRYNVSFPDGQKTRPQNTFVGESIGPDRRQVIVFRRRSDI

SEQ ID NO: 1305 - protein, 526 aa, Piriformospora indica
  misc_feature (1)..(526): Public GI ID no. 353240577
  misc_feature (1)..(526): Piriformospora indica DSM 11827
  misc_feature (125)..(493): Pfam Name: p450 Pfam Description: Cytochrome P450
  misc_feature (1)..(526): Bit score of 309.6 for HMM based on sequences of Figure 9
  misc_feature (1)..(526): Functional Homolog Of SEQ ID NO. 1274
MNTTILNDFASQIVDKLPENVQEHLSHVTTTRAVQIGLGLVVVGHLYRSWTNRIPVPRYGGIVSFSSLLSTIRMSMRGPADWLEYYSKYPMAMMPAGERWHLVVRGEFVDELNRAPDSVLSSHSATEEALQVPHTLGSVITENEYHVQIIRNYLTRHLHTVFPEVYDEIKHTFDTDPTLNNNEWKELEVFPWVLQVVAKASNRVFVGVPLCRDPGWLSVVIDGAVSVVKTATFINLFPILLRNLVGRLVSRKTSRLQRASVLAKDVIEAHLNKEDKTEKTDFLDWLISVAPPEEHNVKDITRRIVAINFAAIHTSSLNLTHALYWITARPDYLEPMREEIEAVTSEMGWSKNAIGQMPKVESFMKECMRLVPLAPSTMNKRVIQPFTFSNGVSPPIGTVVSAHVYATHMNESIYGNPDKFDGFRFVKPEEDAEARAKETIYSTSPNYMAFSHGRHACPGRFFASMELKIMFAYLVLNYDFSWPAEVTKNLKPEERYRPKDIWFGGAILPDPKAKILVRKRQKSPLA

SEQ ID NO: 1306 - protein, 530 aa, Trichophyton equinum
  misc_feature (1)..(530): Public GI ID no. 326484981
  misc_feature (1)..(530): Trichophyton equinum CBS 127.97
  misc_feature (90)..(517): Pfam Name: p450 Pfam Description: Cytochrome P450
  misc_feature (1)..(530): Bit score of 576.5 for HMM based on sequences of Figure 9
  misc_feature (1)..(530): Functional Homolog Of SEQ ID NO. 1274
MEATNVSSGLLGPVYTALPEIEWNSRQGFALFIVAILSLHLLRTFKESLFGVKAPMVGYRSFFEPKWLLRLRFVRGSMSIIRGGYSKYKDSMFKISRNDADILVISNKYVDELRNLPEEELSGIEAHIRNLLGSISTTHVMLETNLHTRVLQTKLTPALGLIFDDMKDELNFALETELPECKDKWVPISINHLMLRLLARVSARIFVGRANCRNEEWLSASIDYTENIFITVMTLRMMPRYLHPFVAPLLPWYWRIRSNLATAKRFIGPIIRERREAEARQGKDYQKHEDLLQWMMDGANEKESNPDMIAHIELLLTLASIHTSSMASSNVMYDLCAHPEYFEPLREEMLSARREDGGWRKTTLTKLRKLDSFLKESQRMNPPSQLAFNRVVRSTLKLSDGTVLPAGTHFNIASDAIMNDPAKLPGGGDPEVFDGFRYERLRSDPAHSENANRFQLAMTDSNNLHFGHGKYACPGRFFASNEIKMIITELLLRYEFKYPEGQDRPRSLSADENLYPDPDAKVLIRRREEM

SEQ ID NO: 1307 - protein, 397 aa, Tuber melanosporum
  misc_feature (1)..(397): Public GI ID no. 296416849
  misc_feature (1)..(397): Tuber melanosporum Mel28
  misc_feature (50)..(380): Pfam Name: p450 Pfam Description: Cytochrome P450
  misc_feature (1)..(397): Bit score of 322.2 for HMM based on sequences of Figure 9
  misc_feature (1)..(397): Functional Homolog Of SEQ ID NO. 1274
MLINLTNRQHVRRPAGRDTPRLGFRASGICYQWLVFFRTHCRFSCEWLSVDLFPTILRIVARVSARSFIGLPVCRNEDWLKLAITFTEDLIATASNLGTISKLFRPFYAYMWNSAKTIKSHKRKAQTLLAPTIQKRFKEQRLAEENGTVYQGPNDLLQWLIDRVEPHHKTVDALSELQLLIGLASVFATAGTLVGMIFDLAEYRDCIQPMREEMEAAISENSGALDRGVLRKMRKTDSFLRESMRMGTLLLSFNRMVMKNVTLSDGTYLPKGTLVAAPALMFSSDPDFVEDPETFDGFRWYKKTLEAKDGVQMSNGSATTSSNNLAFGHGKHACPGRYFAVEEIKTILTFILLQYDIKYPEGQSRPPNIRIGEIASPNRTQKIMFKKLPGPKTFSFL

SEQ ID NO: 1308 - protein, 401 aa, Coccidioides immitis
  misc_feature (1)..(401): Public GI ID no. 119186083
  misc_feature (1)..(401): Coccidioides immitis RS
  misc_feature (118)..(380): Pfam Name: p450 Pfam Description: Cytochrome P450
  misc_feature (1)..(401): Bit score of 479.9 for HMM based on sequences of Figure 9
  misc_feature (1)..(401): Functional Homolog Of SEQ ID NO. 1274
MEAHIQTLLGPITGTDILLDGDLHTKVLQTKLTPNLGHLIGPLKEELEFAMSMELPDCKDEWVEIQMHGIIRRFVARLSARAFTGPIACRNEEWVAANTAYPTNIFTTIGPLRMFPSFMRSSVAPFLSSYWRIRSNIATAKRVIVPIINQRRRDEASGDPNYEKPKDLLQWMLDTAKPKDAAPASLAHRLLALSLGSLNTTTTAAVQTLYDICNHPEYFEPLREELLDSLTANGGWDKATLSKLHGFDSFMKESQRVNPPSYLSFNRVVRKPLTLSDGTRFPKGTHFGMPAYSILQDPSIVENPTEFDGFRYKKIRQQPKEANKHQYASTDSNNIHFGHGKYACPGRFYASHVVKLIVGHLILEYDFKFPEGKCRPQNLNIDENVYPDPSATLLIRRRQMA

SEQ ID NO: 1309 - protein, 518 aa, Arthroderma otae
  misc_feature (1)..(518): Public GI ID no. 296818735
  misc_feature (1)..(518): Arthroderma otae CBS 113480
  misc_feature (176)..(503): Pfam Name: p450 Pfam Description: Cytochrome P450
  misc_feature (1)..(518): Bit score of 385.1 for HMM based on sequences of Figure 9
  misc_feature (1)..(518): Functional Homolog Of SEQ ID NO. 1274
MAGLLEGHPTTHLGLVVLLLAGVVLICLKIAPWTRKEPLSRFPVIKLPSNDMQPGLTQGSILTMQYPDQPYDIQVPAKRMTILPRKYLDEIKRFPESQMSFKALVKDAMVGEYTLIATHDHSLVTALRRDLTQNIVHAHELLQEEAVSVVNKKLGFCGNGKSYGPIFEHEERSCNVEKPKDYAPVKLLPTLLEMVSSMTSRVLVGLPLCHDKEWLGCMLKYTEDAFKAGMILYLTPNIIHPLLNIFLPQLWAVRRHYSTVKRLLGPILQDRVEKLKDPDYKPPRDIIQSFIDINEEKGKSLDFQATNQLMAAFTSMHTTSMNACHALFHLAAAPEYMAPLREEVATVLAEEGNITSKNAMMKLRKLDSFLRETQRLNPSSFVGMERKVLVTTTLSDGTVLPAGSTFGFNSFQINYDPQLWENPEKFDGFRFERLRASEGNEHKYQATSIGLESLSFGLGTHACPGRFFAINEIKILLAHLIMNYDWAFPEGRGRPENITLISALLIDPNSEVLCRRRQ

SEQ ID NO: 1310 - protein, 480 aa, Fusarium oxysporum
  misc_feature (1)..(480): Public GI ID no. 342877777
  misc_feature (1)..(480): Fusarium oxysporum Fo5176
  misc_feature (149)..(468): Pfam Name: p450 Pfam Description: Cytochrome P450
  misc_feature (1)..(480): Bit score of 406.3 for HMM based on sequences of Figure 9
  misc_feature (1)..(480): Functional Homolog Of SEQ ID NO. 1274
MNTFNSMNTTSHETLFQQLVSSLDGIPLMDVHWLIYVAFGAWLCSYVIHVLLSSSTVKVPFVGYRSIFEPTWLLRLRFVWEGGSIISQGYNKFKGSIFQVRKLGTDIVIIPPNHIDEVRKLSQDKTRSVEPFINDFAGQYTRDDEWVEVDIASIMVRLISRISARVFLGPEHCRNQEWLTTTAEYSESLFITGFILRVVPHILRPFVAPLLPSYRTLLRNVASGRRVIGDIVRSQQGDGNQDILSWMMEAATGDEKQVDNIAQRMLILSLASIHTTAMTMTHAMYDLCAHPEYIEPLIEEVKSVVGTSGWDKTALNRLHKLDSFLKESQRFNPVFLLTFNRIYHQPMTLSDGTNLPSGTRIAVPSHAMLQDSAHVPGPAPPSEFDGLRYSKIRSDSNYAQKYLFSMTDSSNMAFGYGKYACPGRFYASNEMKLTLAILLSNFEFKLPDGKGRPRNITIDSDMVPDPRARLCVRKRSLREE

SEQ ID NO: 1311 - protein, 504 aa, Aspergillus fumigatus
  misc_feature (1)..(504): Public GI ID no. 70992027
  misc_feature (1)..(504): Aspergillus fumigatus Af293
  misc_feature (196)..(486): Pfam Name: p450 Pfam Description: Cytochrome P450
  misc_feature (1)..(504): Bit score of 375.7 for HMM based on sequences of Figure 9
  misc_feature (1)..(504): Functional Homolog Of SEQ ID NO. 1274
MDQVYLPQSVRTAVAVSFGVGLLYWVYRLLLQKTKSLKALDLPVLQSVGDQDIVKTLEEGHAKYPDTPFALGVPGQQLVVLPVSEIDTVKALPENQLSIKKHHYNQFLGEYSYMGTKADEFDDAMRYLLVRNTPAVLASFTAEIDYAMSTVLQVPPNSWTRVKPRSIMPKVATILSGRAFVGLPLSREPDWIESNVNYTQDVSRAWMVLRFYPHWIRPLVAPFLREVKTLEQNKALIGRKIAKLLADQEAQKLSPAQEKIPGGDMIDWFKSRYQAQGKTATAQQLTRDQLLATFASIYNLSNALTYVMFDLAANPAAVDELREELDQVLGPNVGAESIDKTALPRLIKLDSFVRESQRLSPTSLVNIPRIVTDPNGLRLKTGHVIPPGYLVMVRAQPINQSPTLYPNPERFDAFRFARLRQQGGANENRWQHTSTGADNINFGHGIWACPGRFFASAEIKVVVAYVIRHYDLRLIEGRPHPKPKYGGLAIFPDAGAEVELKPRV

SEQ ID NO: 1312 - protein, 494 aa, Arthroderma gypseum
  misc_feature (1)..(494): Public GI ID no. 315040165
  misc_feature (1)..(494): Arthroderma gypseum CBS 118893
  misc_feature (114)..(480): Pfam Name: p450 Pfam Description: Cytochrome P450
  misc_feature (1)..(494): Bit score of 394.4 for HMM based on sequences of Figure 9
  misc_feature (1)..(494): Functional Homolog Of SEQ ID NO. 1274
MAGLLETYPSAHLGLVALFLVGVLWICLKAAPKTRKVPSSGLPVVTIKSNDMEPGLAQGSKLYPDQPYEIRMPAKQMIILPRRQLDEIKRFPETQMSFKALVKDTMAGEYTLIATHDHSLVTALRRDLTQNLVHVNELLQEEVVSVVENKLSFCGNDYAPVKLLPTLFDMVSSMTSRVLVGLPLCHNKEWLQCILKYSEDGFKAGMIMHMTPTIIHPLLNMFLPQMRAVRRHYATVKRLLGPILEERIEKLKDPAYKPPRDLIQSFIDINAENGKNLEFQAKNQLMAAFTSMHTTSMNACHALFELAAAPEHVAPLREEIEKVLAEEGCITSKAAMMKLRKLDSFFRETQRLNPSSFVGMERKVLATTKLSDGTVLPAGSIIGFNSFHINYDTQLWENPEKFDGFRFERLRAAEGNDHKFQASSIGLESISFGLGTHACPGRFFAINETKILLAYLIMNYDWAFPEGQGRPKNITLFSALIINPDSEVLCKRRQ

SEQ ID NO: 1313 - protein, 532 aa, Tuber melanosporum
  misc_feature (1)..(532): Public GI ID no. 296420744
  misc_feature (1)..(532): Tuber melanosporum Mel28
  misc_feature (181)..(519): Pfam Name: p450 Pfam Description: Cytochrome P450
  misc_feature (1)..(532): Bit score of 377.8 for HMM based on sequences of Figure 9
  misc_feature (1)..(532): Functional Homolog Of SEQ ID NO. 1274
MGIFIHLVDSGEVKNLYGYPIFGTTLALLSLGIFLLLFKEWSIHGPTNLPIVGVESPGYLARVKARRKFVSHGFQIVRDAYYKHYGKNFVITTNSNEKVILTYNQVKELSNAPDDTVSMSHSSAQTMMAQHTGLSGFVGIHYVREAVKAELNKNLGNMIGDLLEEAQFALRTELPGFATDEWVSVDIPAVALRAVARISGRAFIGLPLCRNEDWLALSIAFTTDVFQEVNKLTPVPKLLRPFFAYIWNSAGSVKSNKRKAQSLLAPVIQRRLEEEGLAEKNGTVRQNHRDLLQWLTARVTPDHKNVNVLSGMQLMTGLASIHTTGTGFTNMIFDLAEHQECIQPIREEMETLIAANGGVLDRATLRKMRKTDSFLRESFRTKLSLLGFNRMIMKNMTLSDGTYLPKGTLVAAPAAIFSSDPGFVEDPEVFDGFRWYKKSLGVADRAVDNNNASNTSPTNLIFSYGRHACPGRYFVVEVMKIMLAFMLLQYDIKYPEGQSRPPNIQMGEFSYPDRRQKILFRKRPGPKKFSFL

SEQ ID NO: 1314 - protein, 498 aa, Serpula lacrymans
  misc_feature (1)..(498): Public GI ID no. 336371322
  misc_feature (1)..(498): Serpula lacrymans var. lacrymans S7.9
  misc_feature (72)..(478): Pfam Name: p450 Pfam Description: Cytochrome P450
  misc_feature (1)..(498): Bit score of 356.8 for HMM based on sequences of Figure 9
  misc_feature (1)..(498): Functional Homolog Of SEQ ID NO. 1274
MLQYVSLLSCALFTLFLSFAISRYLRRPNLDSIPTVGPGGLLTSYWGALVFLFHARETLQKGYTNYKGMAFKVPGLFYWNVILSGPKLVEEIRKAPEDYLSAREGFSDILKPKYTLGHETIHNPYHVSVILTQLTRNLAARFPDIIDEIKTSFDDNIQLVDYEWKSVPAYETIVRVVCRTSNRVFVGLPLCRDPDWNDLVSGFALDVVKVAVTIGLFPDFVAPFVGRLLSNLPRSVRRGMKHLQPIIEERQKNLDEYGSDWDEKPNDMLSWLMDEAEGEECSVQNLTRRMLTINFSAIHTSSINFTHALFYLAANPQYVEPLREEVEATIEEEGWSKNAIAKMRKVDSFLKETLRFEGLSFVSMLRKAVKDFTFSDGTLVPAGSMVSVASFPTHRDNETYENADVFDPFRFANEKQVKEQACQQMVSTNPEFLTFGHGKNACPGRFFAATELKAMLAHIVVTYDVKFENKGLRPANITFGAANSPNTKAKIMFRKRVV

SEQ ID NO: 1315 - protein, 489 aa, Aspergillus terreus
  misc_feature (1)..(489): Public GI ID no. 115390288
  misc_feature (1)..(489): Aspergillus terreus NIH2624
  misc_feature (161)..(478): Pfam Name: p450 Pfam Description: Cytochrome P450
  misc_feature (1)..(489): Bit score of 402.7 for HMM based on sequences of Figure 9
  misc_feature (1)..(489): Functional Homolog Of SEQ ID NO. 1274
MSLASLDLNALWLEHSAVIATLFAFGTALFLVSRSQKQSLNLPRFEVTNDVLKTIEEAHAQYPDDPFILSMVGMELAILPRSGIDVIKTLPEDQVSIKRHHHDVFLGEYTYMGTKSPEFDEAMRYDLTRNTPTVLASFVAEVQYAVEDSFGRPDQWTAFQPRACMSKIASLMSGRAFVGLPLSRDNTWVDATVRYTQDVTRAWLVLRTIPWVLRPFVAPFLPQVRSLKNQRRMTEERLTPLLDPSNAKNRDEIPGGDMLRWFRQRYPQGPTPKQLARDQLLATFASIYNLSNALSYLLFDLATYPEHIEPLRQELQEVLKGEPVNKENIQKLKKLDSFIRESQRLSPPSLANMPRIVTNPRGLKLPSGHTIPCGMRIMVRAHTLNLDPNLWPNPTRFDGFRFSKLREIPGNTFKYQHATTGTDNINFGHGLWACPGRHFASSQMKVVLAHLLLNYDIKLPNRMEKPQQQHFGLAIVPDTEQMVLLKIRG

SEQ ID NO: 1316 - protein, 509 aa, Coprinopsis cinerea
  misc_feature (1)..(509): Public GI ID no. 299740695
  misc_feature (1)..(509): Coprinopsis cinerea okayama7#130
  misc_feature (55)..(490): Pfam Name: p450 Pfam Description: Cytochrome P450
  misc_feature (1)..(509): Bit score of 300.5 for HMM based on sequences of Figure 9
  misc_feature (1)..(509): Functional Homolog Of SEQ ID NO. 1274
MAYLAIAGVSVAIWLVYQWVLFRIDERKVRHIPTVGPDGFISSYIAAWKFVFKGKDLVQEGYDKYKGTAFKIPTLMTPNRWLIVLTGSSMIEDVRKCSTERELSFMDALYEILQKNYVTTSLADKTWENTYNTGVIRGPMTRAFPSQMADLKDEVESCFREMVPRTKEWTPVQAQKTMVSTICRTTNRLFVGLPLCRDPEYCRIQESLTIHMFTVSSLLGLIPEFMRSFVGRILSKFPSNHAKVTKMVYPLFNERMEMDEKHGRKWEGRPNDMISWLLDAVPEEGGFKTVEDMTMRIIFANMGAIHTTSITVTNALFDLAARPEYAAPLREEIEEAVEEMGWSKEAMDRLHKLDSFLKESTRLAGIVCFGMHRKARNDYTFSNGVVVPKGFRTAIASVATYLDPDVYEDPDTFDGFRFVKNKEGSNGDSARDYQGMVSLNPSYLIFGGGRPACPGRYLAVNEAKLVLAHVLLNYDIKLPNDRTTPPEPFWIGESRAMDPKAEILFRRRQ

SEQ ID NO: 1317 - protein, 509 aa, Arthroderma otae
  misc_feature (1)..(509): Public GI ID no. 296818393
  misc_feature (1)..(509): Arthroderma otae CBS 113480
  misc_feature (127)..(486): Pfam Name: p450 Pfam Description: Cytochrome P450
  misc_feature (1)..(509): Bit score of 663.0 for HMM based on sequences of Figure 9
  misc_feature (1)..(509): Functional Homolog Of SEQ ID NO. 1274
MSINVSAIELPSSVQHLPLEVPEFISRTNIYLLAIVALTSIYFLQNFISTWGEFKAPFVGFRSAWEPRWLVGLRFSTGALSQVNEGYEKFKHGMFKIARNDADILVIPNKYVEELRALPDAKISAIRAHIKTKLTPNLGSFVSVIESELQLAMDLEVPKDLDEFKVVSVYDIVLRIVARISARVFIGEPACRNEEWLSTSIHYTENVFATVMILRRLPKFTHTFVAPFLPSYWRLHANLRTAKNFIGPIVLQRRKEQASRQGDPSYERPNDMLQWMMDGANENDGQPHKLAHRQLLLSLASIHTTTMSTAHSLYDLCAHPEYFDELRQEAYDVMKEDGGWKKTTLNKMRKLDSFLKESQRVNPPSLLAFNRIVQTPLTLSDGTHLPKGTHFSVPAAAILKDNDNLPGADTFDGLRYYKIRQHPDEANKHQFAMTDTNNLHFGHGKYSCPGRFFASNEIKIILAHLLMDYEFKYLPGCSRPKNLTADENLYPDPSARLLMRKRIDATTTA

SEQ ID NO: 1318 - protein, 480 aa, Gibberella intermedia
  misc_feature (1)..(480): Public GI ID no. 74676162
  misc_feature (91)..(480): Pfam Name: p450 Pfam Description: Cytochrome P450
  misc_feature (1)..(480): Bit score of 403.2 for HMM based on sequences of Figure 9
  misc_feature (1)..(480): Functional Homolog Of SEQ ID NO. 1274
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTL

SEQ ID NO: 1319 - protein, 513 aa, Trichophyton tonsurans
  misc_feature (1)..(513): Public GI ID no. 326475322
  misc_feature (1)..(513): Trichophyton tonsurans CBS 112818
  misc_feature (144)..(491): Pfam Name: p450 Pfam Description: Cytochrome P450
  misc_feature (1)..(513): Bit score of 384.7 for HMM based on sequences of Figure 9
  misc_feature (1)..(513): Functional Homolog Of SEQ ID NO. 1274
MFTQRQGVSALDEATLAFLVAVVVIGLSIVVLSGYHFLAASNTRWIPRAGKAPGWFGLVNAKRDFIENGAKIIDQGYLKYKDSAFLVQTADMERIVLSPKYLHEIRTAPESILSLREGMSQRHLGKFTTLDVILTSHLQSSVCKTQLTQNLHALIAPMNEEAQFWLAQRIPIDQPSSTVLGHDTLLSVVAGISSRVLVGLPMGRDQDWLRTVVGYTIDVMQASAGLRPYPTLLRPLVAPWLGCIKRLQRHLDTAHRCFGDVFAQRLADPSRTEGEQNVIQWMAETATGDDRSPEVLVKKLLFITLAAVHTSTMAATHALFDLCVMPEYIPLLRKELDEVIAKHGWTLAAINNMPVLDSFLKESQRINHPGLLSFNRKVLQPLRLSDGTVIPAGSFISMATSSIARDPEHYPEPDRFDGLRFYNKRKASNGDSSKRHQFVSTGPENLAFGFGKFACPGRFFAAAQIKMIMATIILRYDVSFPDGQKTRPQNTFVGESIGPDRRQVIVFRRRSDV

SEQ ID NO: 1320 - protein, 508 aa, Leptosphaeria maculans
  misc_feature (1)..(508): Public GI ID no. 312212946
  misc_feature (1)..(508): Leptosphaeria maculans JN3
  misc_feature (135)..(481): Pfam Name: p450 Pfam Description: Cytochrome P450
  misc_feature (1)..(508): Bit score of 363.4 for HMM based on sequences of Figure 9
  misc_feature (1)..(508): Functional Homolog Of SEQ ID NO. 1274
MELQTYAGLSHTLQTTAIALLIFALCTYWPKLKAKAQLAKLPSLHDSKLMGEDQRQAYLQSCRKMYMEGYQKFKKVVYRIVAESGETHIVIPPHLLPELRRLPDDVLSFPKAVEESMEVKYTKILTESDLTLHSIKADLTPALPRLNPMICEEVDASLRQYMPPCPDWTEVKINKVLVDIVARVSGRIFVGPELSEDPAYLEAASNYTMDLMMAVNRVKTMRPWLRPFLANRTKEVRQLREREVQAQRYFKPLINERIHAKKTDPNWQAPDDMLQWMLNRMTDKVPVAEVAQAQLGLTFAAIHTTTLTATNILFTLAVTPEYMEPLREEIRNAMADNDGKITTRTLQQLVKLDSYMKEVSRFHPAGVTSFNRRVLKGITLSNGQYIPPGVLLETPAQAISFDPAYYPNSTTFDGFRHAKLRAAGTGTDHARNQFVTVNEISLGFGYGRHACPGRFFATNEIKMILVRLILAYDVKMPGGRRERWEQIELGRSNSPDASKGLLFRRVEV

SEQ ID NO: 1321 - protein, 516 aa, Phanerochaete chrysosporium
  misc_feature (1)..(516): Public GI ID no. 62318475
  misc_feature (79)..(491): Pfam Name: p450 Pfam Description: Cytochrome P450
  misc_feature (1)..(516): Bit score of 376.2 for HMM based on sequences of Figure 9
  misc_feature (1)..(516): Functional Homolog Of SEQ ID NO. 1274
MSLHQVYDAVVAHGDMGTLLVYMAYSVPLVMFLYSLFSPASLRHIPTEGGPSFPLLSYKAARAYLRDATGILQRGYDKHKGKPFKVAMPDRWVVVLTGKKLVDELQRLPDDAVSFIKGASDLSGTEHMFGRQVIDDPFHVPIIRTHLTKNLAPMFSDVFDEVSIAFQELIPACDGEWVPVHAIKVARSVVARTSNRIFAGLPICRHPEYLNLVINFTVDVAKGRYALLLFPPALKGIAAKILTNIDGRINEGLKYLGPLIEQRMALAEKFGDDSSEKPDDMLQWIIDEVRARNQSVFEVVRTVLLVNFAAIHTSSSSFTHALYHLAANPEFIASLREEIETIVSEEGWSKAAIGKMWKLDSFMRESQRYNGINSVSVKRKALKPLTLSDGTFIPKGTVLVTPTVATHFDDDNYKNPTVFDPFRYYREKERDMSAVKHQFVTTSPDYVSFGHGKHACPGRFFAANELKAMMAYVVVNYDVKFEKEGVRPENIYAAMGISPDPNARVLFRKRESIVSV

SEQ ID NO: 1322 - protein, 396 aa, Tuber melanosporum
  misc_feature (1)..(396): Public GI ID no. 296422933
  misc_feature (1)..(396): Tuber melanosporum Mel28
  misc_feature (96)..(379): Pfam Name: p450 Pfam Description: Cytochrome P450
  misc_feature (1)..(396): Bit score of 323.4 for HMM based on sequences of Figure 9
  misc_feature (1)..(396): Functional Homolog Of SEQ ID NO. 1274
MLINLTNREHARRPAGRDTSRLGRRASGISYQWLVLSSGPILVSQWVSVDFFSTALRIIARVSARSFIGLPVCRNEDWLNLAIAFTEDLIATASNLGTISKLFRPFYAYMWNSAKTIKSHKRRAQTLLAPTIQKRFEEQRLAEENGAVYQGPNDLLQWLIDRVEPHHKTVDALSELQLLVGLASVFATARTLVTMIYDLAEHRDCIQPMREEMETVISENGGELDRGVLRKMRKTDSFLRESMRMGTFLLSFNRMAMKNVTLSDGTYLPKGTLVAAPALMFSSDPDFVEDPETFDGFRWYKKTLEAKAGALMGNGSATTSSNNLAFGHGKHACPGRYFAVEEIKTILTFILLQYDIKYPEGQSRPPNIQIGELASPNRTQKIMFKKLPGPKKFSFL

SEQ ID NO: 1323 - protein, 287 aa, Glarea lozoyensis
  misc_feature (1)..(287): Public GI ID no. 361126544
  misc_feature (1)..(287): Glarea lozoyensis 74030
  misc_feature (4)..(247): Pfam Name: p450 Pfam Description: Cytochrome P450
  misc_feature (1)..(287): Bit score of 346.1 for HMM based on sequences of Figure 9
  misc_feature (1)..(287): Functional Homolog Of SEQ ID NO. 1274
MEQKVLDQIMDEPKKSVDEEQSAFTGWVLKYTKDSEKRDPAVLALNQIVLSFAAIHTSGMAVTHCLYDLAARPEYIQPLREEIEKVIAEDGYEDDGDGIKKLKKSSLPRLRKLDSFMKESQRHAPAGLFGNTRVVVKPLHLSTGHTIPPGTKIAYNLWATQMSTSSLSMSPTYNPPNYHAPAEFDGFRFSNLRAMEGKENKHQFVSTAPDSLSFGHGNHACPGRFFASNEIKVILIEVLRTYDLRLKGDVEGTGGVEKRPEDLVNAGSIMPNPFAEIEFKSRKKDVI

SEQ ID NO: 1324 - protein, 541 aa, Aspergillus flavus
  misc_feature (1)..(541): Public GI ID no. 238487930
  misc_feature (1)..(541): Aspergillus flavus NRRL3357
  misc_feature (173)..(507): Pfam Name: p450 Pfam Description: Cytochrome P450
  misc_feature (1)..(541): Bit score of 347.4 for HMM based on sequences of Figure 9
  misc_feature (1)..(541): Functional Homolog Of SEQ ID NO. 1274
MPVLATFLESHYFFQGIAVALALIFVSNFYRELADGLPYRKIPLVGRSRWEISNTKAKKLFVTSAKDLMVQGFSQGRTVFQAMFTAGPTIVLHPRYVDELKNHPHLDFGEASFFGATIPGFEPFNNQTKEDIVIEVINKKLTHTLGMDWLLVEELPLFSNDFVLSVGQLTIPLSKETAAVLTDKLPGSDEWKPFTFAQEIPHMVARLSSLVFLGEKICRNETWLDVSVNYTIDAFNAARELRDLPAVARPFIHWFMPSMQKLRHHRKVAAEIVQQEIIKRDMIREGKLPEENPPRTHADALDWFREVAAGRPCDETVSQIGLSVAAIHTTSNMLTNVMYDLTAHPEYIQPLRDEIKAIVEQDGILKKTSLTKMKLMDSVMKESQRTNPVSIAFFNRIATEAVVLSDGTSIPRGANVVVSAHVMEDESIYPNAKVYDGFRFYNKRQVPGNEHRYQFVTTSPEHLGFGHGMHACPGRFFANNEIKILLAHLLLKYDWKFADRVDRPKSFLHGTEIICDPTVKLLYKSRQPEVDLSALGEGTTD

SEQ ID NO: 1325 - protein, 535 aa, Botryotinia fuckeliana
  misc_feature (1)..(535): Public GI ID no. 341599458
  misc_feature (209)..(527): Pfam Name: p450 Pfam Description: Cytochrome P450
  misc_feature (1)..(535): Bit score of 477.5 for HMM based on sequences of Figure 9
  misc_feature (1)..(535): Functional Homolog Of SEQ ID NO. 1274
MYQRLKEINFRKPLELEWNSIFLILGFFVLAAILIAWTQRPDEELLLERLKDLDLPIVGVGPNINVSESLEIGTQTYPNSPYVVPADRVPIVILPNSAINIIKSLPEAKISFEKEVYARHLAHLLLKKDQKIFSEPILNSIKQDLTRNISKTLDTLWDEVDYAFEKNIGTLPDDDDGWKNVSVYGKVLNVVALLSGRVFVGAPLCRDEEWIKATIAYTIILGVTVGMLWKRPWWQRKILAPLYFRTLVGVHKKAEELLKPLLEREAALDPSEWEKKAGEQNDGQLIRWLLSHTPQKGGKIDVKQLAHDQLTVSLAAIHTTSITISHLLYDLATYPEHVAPLRTELESVIADHKTAGGNGKLSKVELTKLWKMDSFIKESQRLNPPILVQMRRYLTSPLALPSGHILPSGTFCGVDAQMTNRTVPYYEASPITHQQTPFDTFDGFRFSKLRSVPGNENRYQFVTSSTESLNFGHGTHACPGRFFASNEIKIAFAEVLLKWDVRLKPGEGRPANLYTDTNVMPNMKGEVQMRRRELI

SEQ ID NO: 1326 - protein, 441 aa, Serpula lacrymans
  misc_feature (1)..(441): Public GI ID no. 336369617
  misc_feature (1)..(441): Serpula lacrymans var. lacrymans S7.3
  misc_feature (118)..(428): Pfam Name: p450 Pfam Description: Cytochrome P450
  misc_feature (1)..(441): Bit score of 369.4 for HMM based on sequences of Figure 9
  misc_feature (1)..(441): Functional Homolog Of SEQ ID NO. 1274
MMQEGYDKYKGGLFKIPLMDRWMVIATGSQLIDEMRKVADDELSLQEAVDDILQVEYTFGLEAQRNPYHIPVIRTQLTRNMPALFADMQDEIVHACNDIIPLDGNEWVNVPAYSSMLNITCRTSNRLIVGLPLCRSQEFADLHVKFAVQVIVCASIVNLLPNFIKPFFGRLLTNTPNSIERCTEYIRPIVDDRLRDIEEHGEEWADKPNDMITWLLDEAREERNARAVALRVLVLNFASLHSSSSSFTHALLHLAARPHLLQPLREEAEAVVQEEGWTKAAMDKLKKIDSFLKESQRVSALSLVSMNRKALKPFTFSNGTVIPAGTHVAVASASTHLDEANYANASEFDPFRFADMREKCGEETKHQLVSTDVGYVTFGYGKHACPGRFFASNMLKAIMAHLVLTYDIKLKDEGVRPADQWFGMNCTPNRKAEIMMRKRQS

SEQ ID NO: 1327 - protein, 499 aa, Zymoseptoria tritici
  misc_feature (1)..(499): Public GI ID no. 339475687
  misc_feature (1)..(499): Zymoseptoria tritici IPO323
  misc_feature (171)..(492): Pfam Name: p450 Pfam Description: Cytochrome P450
  misc_feature (1)..(499): Bit score of 405.4 for HMM based on sequences of Figure 9
  misc_feature (1)..(499): Functional Homolog Of SEQ ID NO. 1274
MPIIHHIKDTPRGFIAGAFILFVTARLVWLVTARARRADRPSKFAVFQGETDVIQTMEEANEKLPETPFVLSMHGMQVFVLPRSEIETVKSLPECEVSIKKHHFNVFLGEYTFMGTKADEFDDTMRYTLTRSTPTALDAFTDEIGYAMDQCIGQCDDVWTGIRIRAAMARIASLLSGRVFVGLPLSRDPEWVEATTQYTQNVTTAWMILRLIPRFIRPLVATFLPQVRTLKRFRRATVEKLSPILAAKRQGIHSKTTSDPAGGSMLEWLTAHYKVQPTAEQLARDELLVTFASIYNLTNAISSMVFDLAKYPEHIPELRQELAEVLGPSGIIDKHALSRLRKCDSFIRESQRLSPPSLANIPRIVTNPHGFVTSTGHRIPAGSTVMIRAHPINRDRKLWGDNADQFDGFRFSKLRDMPGNALKYQHTSTGTDNINFGHGIWACPGRFFASAQLKVILAELLRRYDIMRSPQTPNPGQLHYGLAVVPDPEAEVLFRKRML

SEQ ID NO: 1328 - protein, 500 aa, Postia placenta
  misc_feature (1)..(500): Public GI ID no. 327343373
  misc_feature (31)..(484): Pfam Name: p450 Pfam Description: Cytochrome P450
  misc_feature (1)..(500): Bit score of 362.0 for HMM based on sequences of Figure 9
  misc_feature (1)..(500): Functional Homolog Of SEQ ID NO. 1274
MASTPLLYVLVIILSAVYLLRRRSNPLYAIPAVGPSLPLLSYIGALRFTRHAHEMLQEGYIKYKGSAFRLAQLDRWVVVLCGPKMNEELQRMPDDQVSFLDAAEDLVQTKYTIAKNVIENPIHISVMRGPLTRNLAPLLLDVIDEINIGVEEHIPTRGDEWVSVPGLATMTQIVSRASNRVFVGLPMCRDPEYFKIISNFPRDVAKGRFILSITPTFLKPIIGPLLPWSRRTVRQYSALMKPIIEERQRLLLEHRDPHDPDRPNDFMTWLIEEGRAVDQPVDLLVNALLSSNFVAIHTSSISVTHALYNLAAYPEYQQPVRDELVEVIKAEGWTKQAFGKMWKLDSFMRESQRMFGISAISVIRKALKDVTLSNGTVIPAGTLIAVAAEGTHYDEGSYDNPYIFNPFRFSDMREDEGERIKHQYVSTSSEYVSFGHGKHACPGRFFASNELKAILSRLILDFDMKFGGDGHRPPNQWFGSSIIPSQTANVMFRKRPDAGL

SEQ ID NO: 1329 - protein, 498 aa, Postia placenta
  misc_feature (1)..(498): Public GI ID no. 327343325
  misc_feature (33)..(472): Pfam Name: p450 Pfam Description: Cytochrome P450
  misc_feature (1)..(498): Bit score of 347.0 for HMM based on sequences of Figure 9
  misc_feature (1)..(498): Functional Homolog Of SEQ ID NO. 1274
MEDKAQYVFALLGILATLYFVRWSTDPLRHIPAIGPSAPIVSYLSAYRYCRNAQSILQEGYHKYKVFRVSLVDRWVVVVSGADMNEELRKVPDTHVSFQEAADDLVQLKYTIAPDVNEHPIHTPVIRGPLTRNLGALFPDVVDEINVAFPELMPAAAKRGEWVAVSVRDTMGRIVSRASNRIFVGLPLCRNPDYLKTVVEFAFSVAKSRTIINAAPAVFRPIVGHFLPWAKRAVRNAGVHVKPLIRQRVSKMQDAGDDQTDKSCDYLMWLIEEAQKTKQNLDIVVQGILVSNFAAIHTSSNSITHSLLNLAAYPQHVQPLREEIEGIIKEYGWTKEAIGKMWKLDSFMRESQRLSGISGISVMRKVLQDITLSDGTYLPKGTLVVAAAFATHTDERYYENPEVFEPFRFYDMRTENDALRKQYVNTSREFITFGHGKHACPGRFFAVNELKAMMAYIILHYDVKLEEGVSRPENVWIWHNISPASTKVLFRERQSKVQ

SEQ ID NO: 1330 - protein, 499 aa, Serpula lacrymans
  misc_feature (1)..(499): Public GI ID no. 336365283
  misc_feature (1)..(499): Serpula lacrymans var. lacrymans S7.9
  misc_feature (78)..(492): Pfam Name: p450 Pfam Description: Cytochrome P450
  misc_feature (1)..(499): Bit score of 394.8 for HMM based on sequences of Figure 9
  misc_feature (1)..(499): Functional Homolog Of SEQ ID NO. 1274
MENMSLVTYGLASSAFLAVAISKYLNRPNVDAIPTIGPSGILSSYLGAWRFLFHAHDMIQEGYTQYKGMAFKVPNIDNWHVIISGPKLIEELRKAPDNELSFLEATNESLKVEYTLGHEVHHNPYHVSVIRSQLTRNLAARFSDIRDEIAVSFDDIIKPKGDEWVSVPGLNTIMQVVCRTSNRLFVGLPLCRDPDWMDLNIKFTLDVVKGGMIINLFPAFMAPLVAKFLTSVPGSIRRAIKHLQPIIEERRRYIEEYGDDWAEKPKDMLSWLMDEAKGEEQTARLLTMRILTINFAAIHTSSMSFTHALFYLAAYPQYIQPLREEVEAIIEQEGWSKNALVKMRKVDSFLKEAQRFDGLGCISMSRKALKDFTFSDGTFIPAGCIVSVAAYPIHHDADIYADPHVFQPFRFADLREGEGEEVRHQMVSTNPEYIPFGHGRHACPGRFFAANELKAMLAHVVMTYDVKLEDEGVRPVNFIFNTASSPNPTAKVLFRKRAL

SEQ ID NO: 1331 - protein, 523 aa, Coccidioides posadasii
  misc_feature (1)..(523): Public GI ID no. 303318042
  misc_feature (1)..(523): Coccidioides posadasii C735 delta SOWgp
  misc_feature (240)..(502): Pfam Name: p450 Pfam Description: Cytochrome P450
  misc_feature (1)..(523): Bit score of 541.5 for HMM based on sequences of Figure 9
  misc_feature (1)..(523): Functional Homolog Of SEQ ID NO. 1274
MFSLDPVFLNNAHILFHNALFTLSSNKPAIFVISAAVLFLWRLLKDILFSVKAPYVGYESSWEPTWLISRRFSREAPGLIEYGYQRYRDSIYKLSRRDSDILVIPHKFVDELRSLPEEHICAMEAHIQTLLGPITGTDILLDGDLHTKVLQTKLTPNLGHLIGPLKEELEFAMSMELPDCKDEWVEIQMHGIIRRFVARLSARAFTGPIACRNEEWVAANTAYPTNIFTTIGPLRMFPSFMRSSVAPFLSSYWRIRSNIATAKRVIVPIINQRRRDEASGDPNYEKPKDLLQWMLDTAKPKDAAPASLAHRLLALSLGSLNTTTTAAVQTLYDICNHPEYFEPLREELLDSLTANGGWDKATLSKLHGFDSFMKESQRVNPPSYLSFNRVVRKPLTLSDGTRFPKGTHFGMPAYSILQDPSIVENPTKFDGFRYKKIRQQPKEANKHQYASTDSNNIHFGHGKYACPGRFYASHVVKLIVGHLILEYDFKFPEGKCRPQNLNIDENVYPDPSATLLIRRRQMA

SEQ ID NO: 1332 - protein, 495 aa, Serpula lacrymans
  misc_feature (1)..(495): Public GI ID no. 336382397
  misc_feature (1)..(495): Serpula lacrymans var. lacrymans S7.9
  misc_feature (169)..(482): Pfam Name: p450 Pfam Description: Cytochrome P450
  misc_feature (1)..(495): Bit score of 372.7 for HMM based on sequences of Figure 9
  misc_feature (1)..(495): Functional Homolog Of SEQ ID NO. 1274
MPGPIFCTLVVALLLAFLFPRSRRSDLSKIPTVGPSGPLLSYIGAIRFILDARGMMQEGYDKYKGGLFKIPLMDRWMVIATGSQLIDEMRKVADDELSLQEAVDDILQVEYTFGLEAQRNPYHIPVIRTQLTRNMPALFADMQDEIVHACNDIIPLDGNEWVNVPAYSSMLNITCRTSNRLIVGLPLCRSQEFADLHVKFAVQVIVCASIVNLLPNFIKPFFGRLLTNTPNSIERCTEYIRPIVDDRLRDIEEHGEEWADKPNDMITWLLDEAREERNARAVALRVLVLNFASLHSSSSSFTHALLHLAARPHLLQPLREEAEAVVQEEGWTKAAMDKLKKIDSFLKESQRVSALSLVSMNRKALKPFTFSNGTVIPAGTHVAVASASTHLDEANYANASEFDPFRFADMREKCGEETKHQLVSTDVGYVTFGYGKHACPGRFFASNMLKAIMAHLVLTYDIKLKDEGVRPADQWFGMNCTPNRKAEIMMRKRQS

SEQ ID NO: 1333 - protein, 511 aa, Exophiala dermatitidis
  misc_feature (1)..(511): Public GI ID no. 378728369
  misc_feature (1)..(511): Exophiala dermatitidis NIH/UT8656
  misc_feature (149)..(494): Pfam Name: p450 Pfam Description: Cytochrome P450
  misc_feature (1)..(511): Bit score of 405.5 for HMM based on sequences of Figure 9
  misc_feature (1)..(511): Functional Homolog Of SEQ ID NO. 1274
MDALRSFVSQTSVSEVILQRTLCVALALLACGLISLRLIAPAIFTKRPARSSLDELPHFVTENDVWAKIQEGHRQYPDQPFVLSMLGMRVVILPHSSIDVIKALPESVVSIKRHHYDVFLGQYSYMGTKADEFDEAMRYDLQRNTPKVLASFVTEVDYVFMKIFGKPQDWQAFQPRECMARVTALMSGRAFVGLPLSRDEEWAEATVTYTQDVTKAWMVLRMIPSPLHWLLGPYLPQVASLKRHKDMTQRKLKPLLSNELSGEGEDDNTNEPGGDMIRWFRKRYKKPATAEELTRDQLLATFASIYNLTNALSYLLFDIATYPEYIEPLRAELDEFIGPDGTINKENIQKLKKLDSFIRESQRLSPPSLANMPRIVTSPEGLSLPGGYVISCGERVMVRAHTLNLDPQLWENPETFDGFRFEKLRSIPGNELKYQHATTGVDNINFGHGVWACPGRHFASSQMKVVMAYLLRHYDIQLEDGEKKSRQQHFGLAIVPDTKSRVMLKYREDRG

SEQ ID NO: 1334 - protein, 503 aa, Penicillium chrysogenum
  misc_feature (1)..(503): Public GI ID no. 255955605
  misc_feature (1)..(503): Penicillium chrysogenum Wisconsin 54-1255
  misc_feature (148)..(491): Pfam Name: p450 Pfam Description: Cytochrome P450
  misc_feature (1)..(503): Bit score of 286.3 for HMM based on sequences of Figure 9
  misc_feature (1)..(503): Functional Homolog Of SEQ ID NO. 1274
MDVVARFMVSYSGTACAISLFIFGITLLFPFHKSQSFVCMNSHSWDIFRNKAKREFESNAEKLIKDALRKGLTAFQLVTNMGTYLILADQYAEELRNDKRLSAYDALNDVILLELPGLETMFQGSLHNHVSPTAIHAMNRELVHLTRALSDEANHRLQTQWTDSSEWHTVSIHDTVLALVAQMTTRAFVGAELCRNAEWLDIAINFTINRAIAVQAVQAWPWILQPVVHWFLPTCKAVRRQIQRARTILMPVLERERQTMHRKDSSSDRIFSTLTFIDQYAQGSRYDATMAQLRLTAVSVLTTSDMVEKVLARICEHPELIQPLREEVVSVFESSGLHHKSLLKLTLMESVMKESQRLEPATLISMFRAAKKTVTLQDGTTIPKGTRLAFANDLRLDPELYPDPETFDGYRFERMRKDPEQAKLAPFTKTRTSHLAFGHGKHACPGRFLSCDEAKLILCHILLKYDFKALDGRVPDLHVRSMFIQRDTGGMLSVRRRQEEVTL

SEQ ID NO: 1335 - protein, 511 aa, Colletotrichum higginsianum
  misc_feature (1)..(511): Public GI ID no. 380489258
  misc_feature (281)..(476): Pfam Name: p450 Pfam Description: Cytochrome P450
  misc_feature (1)..(511): Bit score of 428.0 for HMM based on sequences of Figure 9
  misc_feature (1)..(511): Functional Homolog Of SEQ ID NO. 1274
MPVVVPDPGPEGVFNTLTRLYEKYPDTPFMLKTSRPIVILPGNLVDDVKNMPEDKVSLHAEVKIDHSMAVTKVGGGTYGSELLPTVRIDLTRHTNGAIPAILDELRFAMDIELNDVGSDKWSTKMLHMSVTKMSALMLSRIFIGRPISRRPEWLRSAIGYTIDLMRARHALNKYPYWLRLIIGKWVPEVKQMQSHLESGKKILMPIVENLVKERTSVKNPNSWEDEKKPLQHYMSDEEALEFDDAQGTFCSWLLKYAIIPEGASNEDIATSLALNQLALSWVSIHSVSYTVTRAMYDLATRPEYFAPLRQEIEDILKEDGFTTDEKGRRIMERTSYVKLRKLDSFLKESMRLCPNKLVNMARIVQSPVTLSTGHTLPAGTRIGVPVYHVMTSPSTQQTYDESAGMAPANEFDGFRFYKLRQQDGNENKFHYITTTSDYLAWGLGTHSCPGRFFSSTAIKVLFVEMLRFWDFRLVGDVDRKGGPAVGHRLNDFTLTTDVTVPLEIKRLEGAK

SEQ ID NO: 1336 - protein, 494 aa, Trichoderma virens
  misc_feature (1)..(494): Public GI ID no. 358389174
  misc_feature (1)..(494): Trichoderma virens Gv29-8
  misc_feature (157)..(481): Pfam Name: p450 Pfam Description: Cytochrome P450
  misc_feature (1)..(494): Bit score of 416.0 for HMM based on sequences of Figure 9
  misc_feature (1)..(494): Functional Homolog Of SEQ ID NO. 1274
MAVSGLLADMESLPTLAWVSPALTAVAVIIVALLSGYRKSPTKFDVPTLEDSPMRYVQEADFKNTIFQVLTPDGPRIFLPRKFANELKPFKRHEASGMKALADRHLGHYTTIDHESDVMLGAIKIDLNRNLGLFVGDVEQEVSYCFETQFPSCEDWTPIDLHETLLRVVAQASARIFVGYPMCRNDEWLECSTKFALDVMTGGEKLKLWHPWLRPFAQYWIPEMRQIRGDHQRALDLLMPELNKRATETRKSDAAPRQDMIEWMQQRAQKLGDKSFDNRELANLQMLTATAAIHTTRLAIIHALYDIAARPEYIAPLREEIKEVTRDTNGVLQKQHLTQMRKLDSFMKESQRHSPPSVATYQRKAMIPIDLSNGFHIPKGTIVQCNTNILDETPAAWGEPHAFDGFRFYRLRENPEDTNRFQFASTSYDSMQFGFGNDACPGRFFASNQIKIILSYILSHYDIKFEDSVKERPKNFMFEVNVMASNTKVLFKRL

SEQ ID NO: 1337 - protein, 499 aa, Trametes versicolor
  misc_feature (1)..(499): Public GI ID no. 14278967
  misc_feature (41)..(491): Pfam Name: p450 Pfam Description: Cytochrome P450
  misc_feature (1)..(499): Bit score of 385.8 for HMM based on sequences of Figure 9
  misc_feature (1)..(499): Functional Homolog Of SEQ ID NO. 1274
MEDPTVLYACLAIAVATFVVRWYRDPLRSIPTVGGSDLPILSYIGALRWTRRGREILQEGYDGYRGSTFKIAMLDRWIVIANGPKLADEVRRRPDEELNFMDGLGAFVQTKYTLGEAIHNDPYHVDIIREKLTRGLPAVLPDVIEELTLAVRQYIPTEGDEWVSVNCSKAARDIVARASNRVFVGLPACRNQGYLDLAIDFTLSVVKDRAIINMFPELLKPIVGRVVGNATRNVRRAVPFVAPLVEERRRLMEEYGEDWSEKPNDMLQWIMDEAASRDSSVKAIAERLLMVNFAAIHTSSNTITHALYHLAEMPETLQPLREEIEPLVKEEGWTKAAMGKMWWLDSFLRESQRYNGINIVSLTRMADKDITLSDGTFLPKGTLVAVPAYSTHRDDAVYADALVFDPFRFSRMRAREGEGTKHQFVNTSVEYVPFGHGKHACPGRFFAANELKAMLAYIVLNYDVKLPGDGKRPLNMYWGPTVLPAPAGQVLFRKRQVSL

SEQ ID NO: 1338 - protein, 350 aa, Metarhizium anisopliae
  misc_feature (1)..(350): Public GI ID no. 322705205
  misc_feature (1)..(350): Metarhizium anisopliae ARSEF 23
  misc_feature (73)..(329): Pfam Name: p450 Pfam Description: Cytochrome P450
  misc_feature (1)..(350): Bit score of 291.7 for HMM based on sequences of Figure 9
  misc_feature (1)..(350): Functional Homolog Of SEQ ID NO. 1274
MALEELLTNKTEWHTIAMRDVVLQLVARISSRVFLGTELCRNETWLRVTRDYTVTGFLAGEELRLWPEFTRPLVHWFLPSCRKLRREVNEARGAIQSTLARRQQLKKDLVAAGKDVPEYDDAIEWFEKAAKGAPCDMTALQLSLSLAAIHTTTDLLTQVLTRISQNLDILGPLREEITSVLGDEGWSKTSLHKMKLLDSVIKESQRMKPPEIVSMMRLAVEDVQLSDGTFIPKNTGVAVSSHRMWDPDLHPDPNHWDGFRFYKMRDDPGKQNVSQLVFASPDYLAFGYGQNACPGRFFASNEIKIALAQIITKYDFELQEGSVPQIHKHGFTLSGDPLLKLRVRRLAEEI

SEQ ID NO: 1339 - protein, 501 aa, Phanerochaete chrysosporium
  misc_feature (1)..(501): Public GI ID no. 354952198
  misc_feature (45)..(493): Pfam Name: p450 Pfam Description: Cytochrome P450
  misc_feature (1)..(501): Bit score of 366.8 for HMM based on sequences of Figure 9
  misc_feature (1)..(501): Functional Homolog Of SEQ ID NO. 1274
MSDYSSLLAYIFISLATLAYLKRLLWPDRQQLEHIPAIGPTAPILSYWGAFRWLSHGTEITQEGYAKYKGRPFKVANFNRWLVVVSGPKLIDDIRKAAEHELSFEEAAHENLEVRYTAGPCIAENSYHVPIVRGQLTRNLPFLFNDVRDEVAKAFGDHVPPTDDWTPVAAHPVIMQIVARATNRVFVGAPKCRDSDWLDLSIQFTADLILGAHIITQFPQFLKPLAARFFTRVPAAIRRGRRHLERTIEHRKACLEQYGADWPDKPNDLISWLLDEAKGEERTIHNLVTRVLTLEFAAIHTTSNSFVHALYQLAAHPEWAEPLRDEIEQVVKREGWSKSSLDKMHRLDSFLKESQRYYALGGVTMVRRAMKDFTFSDGTVIPEGTFVGVAVLATQHDPQYYDDPDTFNPWRFSDLREEGDESGRHLLVSTGIEYFPFGHGRHACPGRFFAAIELKLMLAHIVMNYDVKAELDGVVPPILEFGQNLAPNMKAKVLFKNRQRS

SEQ ID NO: 1340 - protein, 401 aa, Botryotinia fuckeliana
  misc_feature (1)..(401): Public GI ID no. 154289961
  misc_feature (1)..(401): Botryotinia fuckeliana B05.10
  misc_feature (195)..(398): Pfam Name: p450 Pfam Description: Cytochrome P450
  misc_feature (1)..(401): Bit score of 416.7 for HMM based on sequences of Figure 9
  misc_feature (1)..(401): Functional Homolog Of SEQ ID NO. 1274
MASGDLKMLTSGSPLVNGAILLVIILFTGFVLTRPKKLDLPIVGSFGADQRQALVEGTRKLDLTKHLASTIDDMQDEIGYGLDKELGSCKDWTSIPVYPKVTRLVGLLSGRVFVGLPLSRDEEWLKSSIEYALLCMGARDAINAYPEFIRTIVAPFLKEVQILKYVRNRGVELVKPLLATGQENMITWIQNRIKKKDPEKIANNQMSLSFAAIHTTSMAITAAIYDLCAYPEYIEILREEIQQIDGVTKTNLAKLWKLDSFLKESQRLTPPSLVTNVRLVTSPLNLSTGTLPAGSRFGFAAWAIHTPHLPFDGLRYYKLRQIPGNEDRHQFVTTSPESLNFGYGNHACPGRFLAANEIKIVLIELLTKWEFRLKGGERPENILNAMICMPNPRAEVEFRRR

SEQ ID NO: 1341 - protein, 535 aa, Botryotinia fuckeliana
  misc_feature (1)..(535): Public GI ID no. 154290109
  misc_feature (1)..(535): Botryotinia fuckeliana B05.10
  misc_feature (163)..(500): Pfam Name: p450 Pfam Description: Cytochrome P450
  misc_feature (1)..(535): Bit score of 730.3 for HMM based on sequences of Figure 9
  misc_feature (1)..(535): Functional Homolog Of SEQ ID NO. 1274
MSPALFDKSKDMTMSPLFLSASALIVLAYVIKAILSRPQKLDLPIVGKPGADYWQEALLEGTAKVRIFPSAIRLLGSHDPPMVVLPHCTHEEVRNLTEEKVSFQKELHRMFLTPHTKLAKDLPVVVKTVKSDLTRHSPSTVSALEDETTYALETEFGTDESWNKVALFEKVVRIVALVSGRVFVGRPLSRNEEWIQASTQYTVDSAKARDAAVEWPVWARYFVLPFLPDIKKVKTHTAKAADLLKPVINQYLQRAREGKGIRGESSNGVDDAQGTFVGWIMKHTSPELREDPYTLAINQLSLSFASIHTTTMALCHILFDLASHPEFIAPLREEIERVIAEDGFEVDSSGKKSLKKQSMVKLKKLDSLMKESQRLSPVAILTNTRITTSSLHLSTGHTIPKGTRIGYDAQVLNMAGPDLSLLSQDPSTMPQLDPPSVFSPFRFASIRETPGNESKYQFVTTSKEAMNFGHGNHACPGRFFAGIEMKIILIEFLRGWDFRNVGDTEMKGGGRPENFGFDISISPNPVAEIEIKRRV

SEQ ID NO: 1342 - protein, 525 aa, Gibberella moniliformis
  misc_feature (1)..(525): Public GI ID no. 211970315
  misc_feature (90)..(513): Pfam Name: p450 Pfam Description: Cytochrome P450
  misc_feature (1)..(525): Bit score of 449.6 for HMM based on sequences of Figure 9
  misc_feature (1)..(525): Functional Homolog Of SEQ ID NO. 1274
MNKFNSMNNTINETLLRQLVSGLDEIPLMDIHWLIYVAFGAWLCSYVIHLLSSPSTVNVPFVGYRSVFEPTWFLRLRFVWEGGSIISQGYSKFKDSIFQVRKLGTDIVIIPPNYIDEVRKLSQDKTRSVEPFINDFAGDYTRGMVFLQSDLQNRVIQQRLTPKLVSLTKVMKEELDYALTKGMPDMKDDEWVEADIASIMVRLISRISARVFLGPEHCRNQEWLTTTAEYSESLFMTGFILRVVPHILRPFVAPLLPSYRTLLRSVSSGRKVIGDIIRSQQGSENEDILSWMVEAATGEEKQVDNIAQRMLILSLASIHTTAMTMTHAMYDLCARPEYTKPLREEVKGVVGASGWDKTALNRLHKLDSFLKESQRFNPVFLLTFNRIYHQPMTLSDGTNLPSGTRIAVPSHAMLQDSAHVPGPAPPTDFDGFRYSKIRSDSNYAQKYLFSMTDSSNMAFGYGKYACPGRFYASNEMKLTLAILLLQFEFKLPDGKGRPRNITIDSDMVPDPRARLCVRKRSLREE

SEQ ID NO: 1343 - protein, 443 aa, Colletotrichum higginsianum
  misc_feature (1)..(443): Public GI ID no. 380481111
  misc_feature (23)..(419): Pfam Name: p450 Pfam Description: Cytochrome P450
  misc_feature (1)..(443): Bit score of 613.8 for HMM based on sequences of Figure 9
  misc_feature (1)..(443): Functional Homolog Of SEQ ID NO. 1274
MKLYNEVIHAPESELSFAAELYDIFVGKYTHLGESRPEIIESVRVDLTRNLSGILRPVQEEVRFALKQMSQDSAEWKALNAYQLALRMVALMSGRAFVGLPLSRDEGWIRESITFTTDVGKCRMAALNWNAWIRPWVLPFLPEIRHMRRALQKANERMKPLVDEVLRNESALEEKPAKPGAPGAFVSWMMKYLSARNKTSETMGTNQMLLSFAAIHTTSMTTTFALYDLLSRPQYIQALREEIEQVMAEDGTESDEEGRPFLSKVSLGKLKKLDSFIKESQRLSPLNFGGTARRLQKDQTFSDGLKLPAGTAVSFPLWGVYNSSSTTTFSPDYNKGTGNAPPAEFDGFRFARLREQSGREMKHQAATTGSEAFNFGHGPHACPGRFFAVYIIKCIFIELLLNYDIRLKGDDGKSSVPRPPNLFKQMLVFPDPSREVEIRRRAE

SEQ ID NO: 1344 - protein, 517 aa, Nectria haematococca
  misc_feature (1)..(517): Public GI ID no. 302897901
  misc_feature (1)..(517): Nectria haematococca mpVI 77-13-4
  misc_feature (236)..(501): Pfam Name: p450 Pfam Description: Cytochrome P450
  misc_feature (1)..(517): Bit score of 386.9 for HMM based on sequences of Figure 9
  misc_feature (1)..(517): Functional Homolog Of SEQ ID NO. 1274
MENVSSLLASPISVDVQLPQVVTGGKRASYYITIAIVLLAVWLIRSRRKPLELEFPFYKAPKTKWIFDAETLIKDSYTKFRDRVYQIKATEGVQVLVPARLVGELKVLPEDVLSATEAVSDALQTKYTKFTPGHNGDMLALLVRTKLTQNLTRVMPQLKQELEYILATEFPACEDWTPVKWQPFGLRAVARMSGRAFVGPSISRDEKWMNTTINFAIHVFTACVKLQLFPEWARPIGQHFVSELGQIRNDIKTAKEMLLPILEERLRDMDMPGSEDAPDDMIQWLIEGLPEEEKADVTVQAELQLILAAASIHSTNNLLCECLCDLAAYPEVQDELREEAYRILEVEKGWEKKENMAKLKKMDSFMREVQRLRGNITSFIRKVMKPISLSDGTQLPPGTKVLAPQAGISVDERYFPNPERFDALRFYNLRQESDEASNRWQFTSLNDTNINFGAGKHACPGRFFAGNEIKLVLAHLLINYDIRLKKGEDRPMPMAMVMTKAPSPDAELEFRRRSLAV

SEQ ID NO: 1345 - protein, 495 aa, Botryotinia fuckeliana
  misc_feature (1)..(495): Public GI ID no. 169635726
  misc_feature (101)..(487): Pfam Name: p450 Pfam Description: Cytochrome P450
  misc_feature (1)..(495): Bit score of 475.1 for HMM based on sequences of Figure 9
  misc_feature (1)..(495): Functional Homolog Of SEQ ID NO. 1274
MIHFADLGAISLANSNTVIAGCIVFALYYLFQFLNSKKLNFDAPVIGDASDLRSALINGYNQCPNTPFLLPTAAHPTIILPIKYIDEIKSLPPDKISFLEEFRDRYFGHYTAFANNTEGDAVTTSVKVDLTQSIARALENMQAETELAFATELPKPKDWMSVTLYPIILRMVAKVSGRVMVGEPLCRNEKWIQISTTYTRDTFLGGRAVWARHPLFRPIYALYSPELKKVRQHYTDAAEFLRPIFNQRFKEMERDDFEKPQDMIQWMIDNSGNNAKDATFQGRCQLLISFAALHTTSGLLGNAMLDLAARPKYIEALREEIAANLPENTQITKQILTKLRKMDSFLKESQRMNPLNLVTMNRKMMDTVQLSDGTILPKGSFLGMAAGSIGFDPRIFENPDEFDGFRFEKLRQQEGAENKFQLVTTGKDSLAFGHGTHSCPGRFFASNEIKTMLIELLRNYDFQLLPGTERPKNLKSDMSLVVDPTAQIQIKERCR

SEQ ID NO: 1346 - protein, 527 aa, Thielavia terrestris
  misc_feature (1)..(527): Public GI ID no. 367046821
  misc_feature (1)..(527): Thielavia terrestris NRRL 8126
  misc_feature (85)..(508): Pfam Name: p450 Pfam Description: Cytochrome P450
  misc_feature (1)..(527): Bit score of 407.6 for HMM based on sequences of Figure 9
  misc_feature (1)..(527): Functional Homolog Of SEQ ID NO. 1274
MDSGRTTEPAPAEYLTMADIQNIWGAFGAKLPLILPTLVALLVVLLVQNVWSRRPLANIPVVGEELGGDQKRRQAYLSRAADLYLEGYKKFKDSVFRIVTPNKFTVVVVPPKYLRELRKLPDDVVSFDGAIEQSMHAKYTGILTGQSMIPHTIKTSLTPALVRLNPSIAEEVQHSIRQELPSCDDWTPVNINRKLLRIVALVSGRVFIGTELSRSEEYLDAAINYTVELMEARRALDAVRPWLRPLLGNRLPEVRRLNARIAQADRFLRPIVRARQQMREGDAPDDMLQWLLGSQDQFKQYTTEELARMQLGLTFAAIHTTTLTTTNVFYNLAAYPQYIPELRDEIRTVLAEHGGVFTSAALQAMKKVDSFLKETMRFTPAGAVSFQRKVTKSFTLSNGQVIPEGVVIEVPAAAASHDPDVFPDADKFDPWRFSRLREQARAAGEVEASALNQFVSVSPNILTFGFGRHACPGRFFAANEIKMIVANFVLNYDMALPEGVHERYKNLSFGSSSVPDPTKELLFKRIV

SEQ ID NO: 1347 - protein, 499 aa, Phanerochaete chrysosporium
  misc_feature (1)..(499): Public GI ID no. 354961647
  misc_feature (61)..(484): Pfam Name: p450 Pfam Description: Cytochrome P450
  misc_feature (1)..(499): Bit score of 378.5 for HMM based on sequences of Figure 9
  misc_feature (1)..(499): Functional Homolog Of SEQ ID NO. 1274
MFADSPTSLYALVLLGTVVYLLNWLKGSKYKSVPALGPTAPLLSYWGAIRFFLDAQGMLQEGQLKYGGRPFRIATRRYWQYIVSSPKLIDELRRAPDDELSFLDAVNEALELEYTMGPATANNLYHVPVIRNTLTRNLGNLSSEIYDEISNAFADCIPARDEWVAVPALQSIMQIVARTSSRIFVGLPLCRNREFLEISMTYTTDVVKTGLLLNMVPGPLKPIVNRLFSKVEQHIDRTHALLRPIIEERQRMMEQFGDDWPDKPNDMLQWLMDAAEGQEREPRALALRILIVGFAAIHTSSMSFTQALYYLAAHPEYMQPMRDEVEAVLAAEGGWSKGALQKMRKVDSFLKECQRYEGLGMLFLTRKAVKDFTFSDGTFIPKGSYVSTSRAATHGQSEYYRDPYVFDPWRFANLRDETGEGVKHQMVNTSIEYLPFGLGKHACPGRFFAANELKSMMAHLVVTYDVALDMPGEVPRSVHFGPINSPNRTAKVLFRKRRG

SEQ ID NO: 1348 - protein, 590 aa, Podospora anserina
  misc_feature (1)..(590): Public GI ID no. 171679136
  misc_feature (1)..(590): Podospora anserina S mat+
  misc_feature (136)..(491): Pfam Name: p450 Pfam Description: Cytochrome P450
  misc_feature (1)..(590): Bit score of 365.5 for HMM based on sequences of Figure 9
  misc_feature (1)..(590): Functional Homolog Of SEQ ID NO. 1274
MAQTGTLLQTLAAKLPLLLSTAGLLVAVFLAQVLLKGNPLANLPVALDDLPSDEKRRQAFLTRAKDVYATGYKKFKDRVFRIITSNKYHVIIVPPKYLNELKSLPDDTVSFDGAIEQTMHAKYTKLEVGHKLIPHIVKSNLTPSLVRLNPTIAEEVQESFRREMPECDDWTPVNINYKLLRIVAMVSGRVFIGPELSRSEEYVDAAINYTIDLMHARQAVDTMRPWLRPFLANRLPEIRKLNERLAQADAFIRPIVAHRKKLPKEQAPDDMLQWMLDGQSEKFGGEYKTETLARMQLGISFAAIHTTTMTTTNVFYNMAAYPQYVSVLRDEVREVLAQNNNTFTSAALQGMKRLDSFIKETMRIDPAGFAGFQRRVYKPFTLSNGQVIPADVIIEVPAHALAKDPDVFESPDQFNPWRFYDIRQKAREQGAVEEAAQNQFVSVNPLVLTFGYGRHACPGRFFAANEIKMIIANTILMYDMKLMDGHTQRYPNLEFGLSVSSPFRFKQALILTRCSLFLIPPRSFFSSESRLLRREQKHTPIARVLGKHQQLLGSRNKLTDARITPQLLWVMKFTVDGLQIQGPEYREPIF

SEQ ID NO: 1349 - protein, 488 aa, Muscodor strobelii
  misc_feature (138)..(475): Pfam Name: p450 Pfam Description: Cytochrome P450
  misc_feature (1)..(488): Bit score of 360.8 for HMM based on sequences of Figure 9
  misc_feature (1)..(488): Functional Homolog Of SEQ ID NO. 1274
MIFPDGISRLSGASSTLLILATLPVGIIVSFWAYNYWRVFNLKRQRLGVPVINLKDGDYEAAAKEYFTDAEALLKRGHKDYKHGIYQRMIGDYKFTRLGDTLGFHTVLKDLTQKFWGMLPELEEEISYAMRTELPDCKEWTAVTIQPKILRIVALVTGRVFVGSELNRNEEWIATSCGFMKDIYAAGAGVFSYSHLMRPFAARFLVPAVKRVWAHEATGQRLLIPIMKKRKRRELTDPNYQKPNDWMQWLMDNNDKEENPHTLEELVHVHLLLCFAALHTSTMAVTHLLFDLAARQEYIEPLREEQIAVARDFDGEHSKNSYLKMVKMDSFVKESQRHSPPSMLTYARLVMKEFTLSNGLRFKPGDYLVIPAGPISMDDESWEDAEEFRGFRFAELRGKTKEDSHKYQYATVAPNALHFGHGRLACPGRFFAGYEFKAITARFIDNFDIKLVDEKAGRPKNTTAGAAVLLDGSLQLLFKKRKAVLTEI

SEQ ID NO: 1350 - protein, 529 aa, Aspergillus niger
  misc_feature (1)..(529): Public GI ID no. 145254738
  misc_feature (1)..(529): Aspergillus niger CBS 513.88
  misc_feature (79)..(517): Pfam Name: p450 Pfam Description: Cytochrome P450
  misc_feature (1)..(529): Bit score of 475.5 for HMM based on sequences of Figure 9
  misc_feature (1)..(529): Functional Homolog Of SEQ ID NO. 1274
MVNDTELWTLVTTAHPFPVESIHWTYTLLFLAVGAYCCSIFWSQIFGYKLPIFGTKSPWEPVIISNFRFFHHAEQVLQQGYNECKNRIFQFRRADTDMLVLPPKYVDEIRRLPNHIASPTLAHVHNLMGSRINMHIILRNNLHFRTLQVKLTPNLNSITLPMQEEVNYAIEKDFTKSEDEWVTIKPYHTILDLVSRVSARIFLGQPLCRNPQWLELSTQFTENVFVSLVFLRLFPMWTHGLLTWFMPSSYRGSAYIRQAKKLLVPEINRRRKLASEGIEEPAENKHNLLSWMMEIATPEESDPASLAHLEVVLSLAAIHTSQMNAVHVLYDLLVHPEYLEPIRDEIRTTILENGPWMTWEKSAFSKLRKLDSFMRESQRVNPPTLLSMHRVLLQEVTLSDSTRLPKGAHISMAVNAIQNDPEVTTNPETFDGFRYYKLRQREGEAHLHQFSTTQDRILNFGHGANACPGRFFAALEIKIILVRLLMDFEWKLKEPGKRPENLHAHEFIFPNPDAEILMRRRPASECLQL

SEQ ID NO: 1351 - protein, 534 aa, Trichophyton rubrum
  misc_feature (1)..(534): Public GI ID no. 327292709
  misc_feature (1)..(534): Trichophyton rubrum CBS 118892
  misc_feature (90)..(509): Pfam Name: p450 Pfam Description: Cytochrome P450
  misc_feature (1)..(534): Bit score of 575.8 for HMM based on sequences of Figure 9
  misc_feature (1)..(534): Functional Homolog Of SEQ ID NO. 1274
MEATNVSSGLLGPVYTALPEIEWNGRQGFALFIVAILSLHLFNVFKESLFGVKAPMVGYRSFFEPKWLLRLRFVRGSMSIIRGGYSKYKDSMFKISRNDADILVISNKYVDELRNLPEEELSGIEAHIRNLLGSISTTHVMLETNLHTRVLQTKLTPALGLIFDDMKDELNFALETELPECKDKWVPISINHLMLRLLARVSARIFVGRANCRNEEWLSASIDYTENIFITVMTLRMMPRYLHPFVAPLLPWYWRIRSNLATAKRFIGPIIRERREAEARQGKDYQKHEDLLQWMMDGANEKESNPDMIAHIELLLTLASIHTSSMATSNVMYDLCAHPEYFEPLREEMLSARREDGGWRKTTLTKLRKLDSFLKESQRMNPPSQLAFNRVVRSTLKLSDGTVLPAGTHFNIASDAIMNDPAKLPGGGDPEVFDGFRYERLRSDPAHPENANRFQLAMTDSNNLHFGHGKYACPGRFFASNEIKMIITELLLRYDFKYPEGQERPRSLGADENLYPDPDARVLIRRREEISHPF

SEQ ID NO: 1352 - protein, 501 aa, Laccaria bicolor
  misc_feature (1)..(501): Public GI ID no. 170109428
  misc_feature (1)..(501): Laccaria bicolor S238N-H82
  misc_feature (131)..(487): Pfam Name: p450 Pfam Description: Cytochrome P450
  misc_feature (1)..(501): Bit score of 355.0 for HMM based on sequences of Figure 9
  misc_feature (1)..(501): Functional Homolog Of SEQ ID NO. 1274
MDPSELSWKQWLFLTLTLYFIYKWFLKRHPLDHIPTIGYSSHLFSFFSAIRWIWAGKEIVLEGYAKYPDRAFKVPLLESWLVIVNGPKLVDDMRRASEEYISFTRSISGFFQFDYTFGPQVSRDPYHIHILRSQLARNVEPCFEDIKEEMVLAFDKAVPLPSQGEEWVTLPAYDTSLEIVSKISARFFVGLPLCENEEYRLLCVHATMEIVKSRILNFLPVFLRPLGGRIFTDIHGTVERTKRLMAPLVEERLKQERLHGRDWPGKPNDLLSWLLDGHPRPEERTVHDLDVRTLLVTFASIHTTSQAFTHALYDLATKPEYIQPMREEIEALIENQGWTKNTVTKMYKVDSFLRESQRFDGMAVVSLGRKVLKDFTLSDGTCIPAGSSLSANSWSVHHDEAHYANAHVFDGFRFVREGGLKQPLMAIPTLDYMAFGHGRPTCPGRFFAVTELKSMLAHVILNYDVRLENGGPRPANMFIESSVVPDRNGRVMFRRRKAAAA

SEQ ID NO: 1353 - protein, 531 aa, Trichoderma reesei
  misc_feature (1)..(531): Public GI ID no. 340521233
  misc_feature (1)..(531): Trichoderma reesei QM6a
  misc_feature (81)..(518): Pfam Name: p450 Pfam Description: Cytochrome P450
  misc_feature (1)..(531): Bit score of 494.9 for HMM based on sequences of Figure 9
  misc_feature (1)..(531): Functional Homolog Of SEQ ID NO. 1274
MANATLPLGTPYRDIPLSSLEELTTPWALIAMIGGLYMLSSIFSQIFGYKYPIFGISSQLEPIVVSNFRFFRRAEDILNEGYQACKGKIFQFRRADTDMLVLPYKYVEDIRKLPNSVASPTVAHVHNLMGSSTNMHIILRSNLHFRTLQLKLTPNLNSLTKPMQEEVNYAVEKELTESEDEWVTIKPYHTILDFVARVSARIFLGKPLCRDPEWLEVSTQFTENVFVSLVFLRLFPMWTHGFLNWFMPSSYKGTAYVRKAKKLLVPEINRRRSLEAQGHVFPEEEKHNLLSWMMEIATPSESDAAALAHLEVVMSLASIHTSQMNAVHCLYDLLAHPEYLEPIREEIRGVVAEAGPWMTWSKPQFSRLRRLDSFMRESQRFNPPTLLSMHRVMLQDAKLSDGTILPKGAHISMPVNSIQNDPEVTPEPEKFDGFRYYNLRQNEGQSHLHQFSTTQDRILNFGHGPNACPGRFFASLEIKIILVRLLMDYEFKFKHGNERPANLRAHEFIFPNPDAEILMRRRPAGERLPLY

SEQ ID NO: 1354 - protein, 706 aa, Arthroderma benhamiae
  misc_feature (1)..(706): Public GI ID no. 302502804
  misc_feature (1)..(706): Arthroderma benhamiae CBS 112371
  misc_feature (90)..(510): Pfam Name: p450 Pfam Description: Cytochrome P450
  misc_feature (1)..(706): Bit score of 576.7 for HMM based on sequences of Figure 9
  misc_feature (1)..(706): Functional Homolog Of SEQ ID NO. 1274
METTNVSSGLLGPVYTALPEIEWNGRQGFALVIVAILSLHLFNVFKESLFGVKAPMVGYRSFFEPKWLLRLRFVRGSMSIIRGGYSKYKDSMFKISRNDADILVISNKYVDELRNLPEEELSGIEAHIRNLLGSISTTHVMLETNLHTRVLQTKLTPALGLIFDDMKDELNFALETELPECKDKWVPISINHLMLRLLARVSARIFVGRANCRNEEWLSASIDYTENIFITVMTLRMMPRYLHPFVAPLLPWYWRIRSNLATAKRFIGPIIRERREAEARQGKDYQKHEDLLQWMMDGANEKESNPDMIAHIELLLTLASIHTSSMATSNVMYDLCAHPEYFEPLREEMLSARREDGGWRKTTLTKLRKLDSFLKESQRMNPPSQLAFNRVVRSTLKLSDGTVLPAGTHFNIASDAIMNDPAKLPGGGDPEVFDGFRYERLRSDPAHPENANRFQLAMTDSNNLHFGHGKYACPGRFFASNEIKMIITELLLRYDFKYPEGQERPRSLSADENLYPDPDARVLIRKREEIWLIDIKPSNVLVNYGKDTRFKEVQLADFGSTVQESSTYARRGDPIGTPMLKSPEAHLQMKWGNSTDIWSFGAEGFHIFRPNVPVDHDDYDVKILMKHHRCFGPFPASYEEIADQERLAFLAWIMQNSPREMLRPFHLTTTREICPEDKEFVLRTMKLDLRDRPTARQLLEDKWFCQ

SEQ ID NO: 1355 - protein, 529 aa, Aspergillus niger
  misc_feature (1)..(529): Public GI ID no. 350630566
  misc_feature (1)..(529): Aspergillus niger ATCC 1015
  misc_feature (79)..(517): Pfam Name: p450 Pfam Description: Cytochrome P450
  misc_feature (1)..(529): Bit score of 475.6 for HMM based on sequences of Figure 9
  misc_feature (1)..(529): Functional Homolog Of SEQ ID NO. 1274
MVNDTELWTLVTTAHPLPVESIHWTYTLLFLAVGAYCCSIFWSQIFGYKLPIFGTKSPWEPVIISNFRFFHHAEQVLQQGYNECKNRIFQFRRADTDMLVLPPKYVDEIRRLPNHIASPTLAHVHNLMGSRINMHIILRNNLHFRTLQVKLTPNLNSITLPMQEEVNYAIEKDFTKSEDEWVTIKPYHTILDLVSRVSARIFLGQPLCRNPQWLELSTQFTENVFVSLVFLRLFPMWTHGLLTWFMPSSYRGSAYIRQAKKLLVPEINRRRKLASEGIEEPAENKHNLLSWMMEIATPEESDPASLAHLEVVLSLAAIHTSQMNAVHVLYDLLVHPEYLEPIRDEIRTTILENGPWMTWEKSAFSKLRKLDSFMRESQRVNPPTLLSMHRVLLQEVTLSDSTRLPKGAHISMAVNAIQNDPEVTTNPETFDGFRYYKLRQREGEAHLHQFSTTQDRILNFGHGANACPGRFFAALEIKIILVRLLMDFEWKLKEPGKRPENLHAHEFIFPNPDAEILMRRRPASECLQL

SEQ ID NO: 1356 - protein, 448 aa, Grosmannia clavigera
  misc_feature (1)..(448): Public GI ID no. 320586089
  misc_feature (1)..(448): Grosmannia clavigera kw1407
  misc_feature (96)..(434): Pfam Name: p450 Pfam Description: Cytochrome P450
  misc_feature (1)..(448): Bit score of 401.9 for HMM based on sequences of Figure 9
  misc_feature (1)..(448): Functional Homolog Of SEQ ID NO. 1274
MPLHTILKPVQIAANLVNAALSNESPHKYRDRLFKIPTSNKPMVIVPGHLLDDLKSFPEEAISFRHEMYDRYLGQYTSVASNSSAMIHSVKFDLTKGIGNLIPVIQEEVEYALKDFMSTHASDPEGWVRAPIYGMSTRTIALVSGRVFVGLPLSRNEEWIQMAINSTIDSFVGAAMMWEYPSWSWPIMQWIVPQTKRVRYYRRRVGEMLNPIITTRLQAGSDTKKPADMIQWLIDNSNGRGGDLPFQANEHIVMNVAAIHTTGGQLAHTIFDLARRPEYIYILREEMDNVLSDEGPITKQDLFRLKKMDSFLREVQRMSPPSMVSVNRKALKSLTLPNGLVIPKGTSLAASPACVSRDSLIWDNPDEFDGLRFYKLREAEGEEKYQFATVNEDALSFGHGRHACPGRFFASAELKVVLVHILREYDIKLCDDYSNDRDLNRFVEVMAA

SEQ ID NO: 1357 - protein, 530 aa, Trichophyton tonsurans
  misc_feature (1)..(530): Public GI ID no. 326475321
  misc_feature (1)..(530): Trichophyton tonsurans CBS 112818
  misc_feature (90)..(517): Pfam Name: p450 Pfam Description: Cytochrome P450
  misc_feature (1)..(530): Bit score of 577.7 for HMM based on sequences of Figure 9
  misc_feature (1)..(530): Functional Homolog Of SEQ ID NO. 1274
MEATNVSSGLLGPVYTALPEIEWNSRQGFALFIVAILSLHLLRTFKESLFGVKAPMVGYRSFFEPKWLLRLRFVRGSMSIIRGGYSKYKDSMFKISRNDADILVISNKYVDELRNLPEEELSGIEAHIRNLLGSISTTHVMLETNLHTRVLQTKLTPALGLIFDDMKDELNFALETELPECKDKWVPISINHLMLRLLARVSARIFVGRANCRNEEWLSASIDYTENIFITVMTLRMMPRYLHPFVAPLLPWYWRIRSNLATAKRFIGPIIRERREAEARQGKDYQKHEDLLQWMMDGANEKESNPDMIAHIELLLTLASIHTSSMASSNVMYDLCAHPEYFEPLREEMLSARREDGGWRKTTLTKLRKLDSFLKESQRMNPPSQLAFNRVVRSTLKLSDGTVLPAGTHFNIASDAIMNDPAKLPGGGDPEVFDGFRYERLRSDPAHPENANRFQLAMTDSNNLHFGHGKYACPGRFFASNEIKMIITELLLRYEFKYPEGQDRPRSLSADENLYPDPDAKVLIRRREEM

SEQ ID NO: 1358 - protein, 525 aa, Colletotrichum higginsianum
  misc_feature (1)..(525): Public GI ID no. 380490852
  misc_feature (157)..(499): Pfam Name: p450 Pfam Description: Cytochrome P450
  misc_feature (1)..(525): Bit score of 383.1 for HMM based on sequences of Figure 9
  misc_feature (1)..(525): Functional Homolog Of SEQ ID NO. 1274
MTNATDPLALAGVLDAQFSKHWPTATAGVIFVVFALLAQSWLAVDPLADVPVVGKGGRWARRKQYLQGQGNQLYIDGYKQFKDSIFRLTTSKKKDTICVPPKYLPELKKAPDDVISFAKAIDESMQSQYTKISGDTPILVHAVRASLTPALPRLNASISDEVVESMRLELPQSTDWTEVNINAKLLRIIAMVSGRVFIGSELCRDERYIDASINYTVDLMTAVHVIALVPSFLRPIVATWLPTTKKLYRRIAEAESVFRPIVTARREAAAANRDDYREPDDMLQWILNAQTKFGQLSDRDLASAQLGISFAAIHTTTMTTTNAIYWLVAKPELIPMLRDDVQQALLESGGEFTSGALQNMKKLDSFLKEVMRASPLSAGSFTRKVLKSLTLPNGQTIPAGMNIETPAAGVNNDPEIFPDPEVFDALRFYRLREAKEHAASGAKAAEVVMQAQFVSVGTTHLTFGYGKHACPGRFFAVNEIKMIMANILCHYDVKLPDGETGRYENLVFGASSVPDPKKTILIRKL

SEQ ID NO: 1359 - protein, 529 aa, Pyrenophora teres
  misc_feature (1)..(529): Public GI ID no. 330928050
  misc_feature (1)..(529): Pyrenophora teres f. teres 0-1
  misc_feature (151)..(520): Pfam Name: p450 Pfam Description: Cytochrome P450
  misc_feature (1)..(529): Bit score of 371.8 for HMM based on sequences of Figure 9
  misc_feature (1)..(529): Functional Homolog Of SEQ ID NO. 1274
MSSKQYLDTATAVPAHHGGHTTINTQMLGTLSQSLSTAAIAAFIFAVFVYLPTIQRKIHLSKLPVHNTSDNSGEKQRQEFLSSAKNIYEQGHAKFKDRAFRVYTDDRRDTIVVPSSLLPELRKLSDENLSFSKFVESAMESKYTNINTEAKLTTHTVKSDLTPALPRLNTMVGEEVDNAIREYMPPCDDWTEVCINEKLVDVVSKVSGAVFVGREMSKNPEYLDACSNYTLDLMTAVSAIKRVRPWLRPIQAPRLPEIIKLRQREAVCCRLLEPIIKERMHLKATDPTWQEPDDMVQWLINRDGGKESVEKMAMFQLGLIFAAIHTTTMTATNILYTLVSTPEYLDPLRDEIRQLMAENDGKITFRALQKMEKLDSYMKEATRIYPTGVTAFGRTVMKGFTLSNGQYIPQGVIIETPAAAVYTDGEYYSNPEIFDGYRSFNLRASGNAADIARNQFVTTNELNLNFGYGRHACPGRFFATNEIKMVLARMILEYDMKMPDGQTERYPQIDMGRMSIPNPTKTLLFKKFV

SEQ ID NO: 1360 - protein, 503 aa, Schizophyllum commune
  misc_feature (1)..(503): Public GI ID no. 302690250
  misc_feature (1)..(503): Schizophyllum commune H4-8
  misc_feature (40)..(497): Pfam Name: p450 Pfam Description: Cytochrome P450
  misc_feature (1)..(503): Bit score of 335.6 for HMM based on sequences of Figure 9
  misc_feature (1)..(503): Functional Homolog Of SEQ ID NO. 1274
MGIDLAPDMDDCRTLVGCLTAIALYVAYTYLSVPSLTGIPIVGPSGWFASYRGKKVFSEHANEMIREGVEKYPSGMFRVARLGWTVIVSGRQLINELSSAPADELSFFHSVSEAMQTKHTLGPTASLSRGHVHKDVIRGELTRNIAVRFDDIYDEICAAFKGNITFACGEVPAYTTALSIVTRTSNRYFVGLPLCRNQDYLDSVSQFARKVSQSAGRIKKWPTFLQPLVGHILSPFREHYPDLSAHLGSLVAHRLREDELLGSDRPDVPNDAITWMLKHESLDDRLEATIMRIMLINFVAVHTSTNMLTHALFFLASQPEYIAPLREEVEEVIARQGWTRASLRDMHKVDSFLREVGRTSQSNCLSLSRRVMKEGGFTFSNGVTLPKGTYVSASLHAAHMNPDVYPNPEVFDGFRFSRLREKDPAKYQVHTTDFDYLHFGHGHHACPGRIFAANELKAMLAHLVLHYDVQLEGGSRVRPENEWTDEFSCPDTKAKVMFKKRVV

SEQ ID NO: 1361 - protein, 516 aa, Aspergillus niger
  misc_feature (1)..(516): Public GI ID no. 350631043
  misc_feature (1)..(516): Aspergillus niger ATCC 1015
  misc_feature (78)..(489): Pfam Name: p450 Pfam Description: Cytochrome P450
  misc_feature (1)..(516): Bit score of 353.1 for HMM based on sequences of Figure 9
  misc_feature (1)..(516): Functional Homolog Of SEQ ID NO. 1274
MAVILEVLDNQHLLQGVVLALVLVFVSSFYHEIADSFPYKNIPLVGKGKWEITNTKAKHRFVTSAKELFAEGFSQGRKAFQVHFSARPTIVLHPSLTNEVKNNPLLDFNEANKKSFFGSKIPGFEPFDGLDHEGIFLEVINKKITQGLGQLTTPLSRETIAVLNEKLPDSGEWLPFTFAQEIPHIVARLSSLVFLGEKICRDKQWLDVSVNYTIHAFVAARDLRLYPTVLRPFVHWFLSSTRRTRQDIRVASAIINREVEKRKLIREGKLPEEDPPRTHADTLDWFEEVAAGRPLDLAVAQVGLSLAAIYTTSNLLTNIMYDLTAYPEHIQPLRDEIKAIISEDGGLKKTSLTKMKMMDSVLKESQRMHPAGVAFINRVAMGDITLSDGTRIPKGASIAVSAHNMEDESLYPNAKTYDGFRFYKKRQEPGNEHRFQFVTTSPEHLGFGHGMHACPGRFFASNEVKILLIHFLMRYDWKFADGRTTRPMNFMHGTESICDPTVEFLFKPRQPEVDLS

SEQ ID NO: 1362 - protein, 540 aa, Penicillium chrysogenum
  misc_feature (1)..(540): Public GI ID no. 255931839
  misc_feature (1)..(540): Penicillium chrysogenum Wisconsin 54-1255
  misc_feature (184)..(514): Pfam Name: p450 Pfam Description: Cytochrome P450
  misc_feature (1)..(540): Bit score of 418.1 for HMM based on sequences of Figure 9
  misc_feature (1)..(540): Functional Homolog Of SEQ ID NO. 1274
MAVIFSSSALGSHTHVDRHLVRQPIRDLENNVDMLDHLSRVLALSSQYHALGAAIALFACACAYALVAPRQPPKFPAPQLYDETGPIDLIALDKTIKEGFQNYKGKYFTLKEAHGETVILPTKFMEELKALPDNMLNLDDEIDERFLSEYSLFTTTSVGGRISTVVNSIKNELTKTLGNLMGDIHEEVVYSFQELIPPCDDWTELDIQSKLVHIVALVSGRIFVGLPMSRNQEYLDCIIEFTLNVFFAVPEIRAYPRLLRWTSRYLNTKVRAVHKSLATMRRLMAPIIDDTKQQLEMGTGPHNMCAWNIKNSNQKERDSLNIQAQMQLATSMAAIHTTSMTVTNAIFDLAARPEYLQPLRDEFQDLRAIEPLPYLDKTSMPKLRKLDSFLKESHRLSPISLLNMRRKIVQPITLHDGTVLQPGMHIAFPLHQISNDEDLWENPSQFDGFRFQKLRDLPGNESKYQFTATGTNNLDFGHGVHACPGRFFAANEIKMILVHLIDNFDFKFKGDIGRPDSLWTPGGYHPDPSVRVLLKRRLKA

SEQ ID NO: 1363 - protein, 409 aa, Neurospora tetrasperma
  misc_feature (1)..(409): Public GI ID no. 336466767
  misc_feature (1)..(409): Neurospora tetrasperma FGSC 2509
  misc_feature (54)..(386): Pfam Name: p450 Pfam Description: Cytochrome P450
  misc_feature (1)..(409): Bit score of 305.2 for HMM based on sequences of Figure 9
  misc_feature (1)..(409): Functional Homolog Of SEQ ID NO. 1274
MHTKYTLIPTHEPIIPHTVKTSLTPSLPRLNPQLSEEVQIAFSQEIAPLMSSSPSDWAPININSKLLRIVAKVSGRVFIGPELCHDERYLEAAVGYTVSVMEAQRAVERMNPWVRPIAAWRLQEVRKLAQMERDATAFLRPVVEARREKQRKGEEKDNDMLQWLMDSADQGQGKQHGKWGEDTTTTRKLARLQLAISFAAIHTTTLVTTHAVYSLAADPKLQATLREEIQSVLQEHKGVFNTSALQAMKKTDSFLKETMRFHPLGQTSFSRKVLRTFALSNGQVIPKGSTIEVPNYAVSRDPEAYSHPDVFDPLRFYNLRNEAREKGEAEQAASGQFVSINKEFLTFGYGRHACPGRFFAANEIKMILANLVMTYEMGLVEGETERYRDWDIAAGTIPDPTKDVMFRKL

SEQ ID NO: 1364 - protein, 500 aa, Taiwanofungus camphoratus
  misc_feature (1)..(500): Public GI ID no. 328796058
  misc_feature (35)..(486): Pfam Name: p450 Pfam Description: Cytochrome P450
  misc_feature (1)..(500): Bit score of 357.9 for HMM based on sequences of Figure 9
  misc_feature (1)..(500): Functional Homolog Of SEQ ID NO. 1274
MDNPTEMICFCVGVLTLLLFVQRRFDPSQKIPAIGPSAPLLSYIGAYRYFRHAQDMLQKGYTKYRGSVFRVPLLDQWVVVVSGAKMNEELWRIPDDKMSFLAAAQDFIQTKYTIAPLLDQLPIHVKVMREQLTRNLGVLLPGVLDEIHAAFNEIIPTLGNEWVSISGLPVMTHIIARVSNRAFVGLPICRDSDYLDVAMKFPMDVMKGKSILSIVPKSLKAVVGPCLPWSRRALRCFSAHLKPVIAERQRLLQELGEDWTDKPIDMLMWLIEEAPSMEQSVDLIVQSILSSNFASTHTSSISLTHALYHLAGSPEYMHPLREEIENVLKVKGWTKDALSNMWRLDSFLRESQRLNGVSGMSVMRKALKDVTLSDGTYIPTGTMVYAAATATHRDPDNYDNPDMFDPFRFSDAKESENDRIKQQYVSTSPDYIPFGHGKHACPGRFFASHELKAILAHIVLNYDLQFEGGGGRPENLWLGTGILPAPNAKIMFRNRQTSDA

SEQ ID NO: 1365 - protein, 529 aa, Tuber melanosporum
  misc_feature (1)..(529): Public GI ID no. 296420105
  misc_feature (1)..(529): Tuber melanosporum Mel28
  misc_feature (83)..(515): Pfam Name: p450 Pfam Description: Cytochrome P450
  misc_feature (1)..(529): Bit score of 420.0 for HMM based on sequences of Figure 9
  misc_feature (1)..(529): Functional Homolog Of SEQ ID NO. 1274
MGVFIQLIDSVEEKKLYGYSLFSTSLALLFLGIYILLKKEWSTHSGTKFPIVGIESPGYIGILKARLSFVANGYKIVRNAYYKYPGKNFVVTTYSYDKVVLTHDQVKELSNAPDDTISISHAAVETMMGDYTGLDQFVGTTFVEDVVRIKLTQNLGSMNEAMLEEARFALNTELPECTTDEWRSVEVFATIIRIVARMSARAFVGFPLCRNEDWLTITMVFTGHVFMTHSKLACVPKPIRPIYSYVRNLVKDIAEDKRKAESLLAPVIRKRLEEESLAKKNGTVFQKPNDMLQWLSDRVDQKHKTTKGLSELQLVLSLAAIHTTSISFLNAIFDLLAHPECIQPIREEMEAIISANNGVLDRVALRKMKKTDSFFKESMRGKIGLFSFNRKVLKSVTLSDGTYLPKGTLITAPTSMFSSDPDFVEDPETFDGFRWYKKSLEAEGNNNYWATTSSNDLAFGHGKHACPGRFFATERMKTILIFILLQYDIKYPEGESRPENIDHGEFSYPDTTKQLLFKKLPGPKKYSFF

SEQ ID NO: 1366 - protein, 689 aa, Trichophyton verrucosum
  misc_feature (1)..(689): Public GI ID no. 302667711
  misc_feature (1)..(689): Trichophyton verrucosum HKI 0517
  misc_feature (90)..(510): Pfam Name: p450 Pfam Description: Cytochrome P450
  misc_feature (1)..(689): Bit score of 575.7 for HMM based on sequences of Figure 9
  misc_feature (1)..(689): Functional Homolog Of SEQ ID NO. 1274
METTNVSSGLLGPVYTALPEIEWNGRQGFALFIVAILSLHLFNVFKESLFGVKAPMVGYRSFFEPKWLLRLRFVRGSMSIIRGGYSKYKDSMFKISRNDADILVISNKYVDELRNLPEEELSGIEAHIRNLLGSISTTHVMLETNLHTRVLQTKLTPALGLIFDDMKDELNFALETELPECKDKWVPISINHLMLRLLARVSARIFVGRANCRNEEWLSASIDYTENIFITVMTLRMMPRYLHPFVAPLLPWYWRIRSNLATAKRFIGPIIRERREAEARQGKDYQKHEDLLQWMMDGANEKESNPDMIAHIELLLTLASIHTSSMATSNVMYDLCAHPEYFEPLREEMLSARREDGGWRKTTLTKLRKLDSFLKESQRMNPPSQLAFNRVVRSTLKLSDGTVLPAGTHFNIASDAIMNDPAKLPGGGDPEVFDGFRYERLRSDPAHPENANRFQLAMTDSNNLHFGHGKYACPGRFFASNEIKMIITELLLRYDFKYPEGQERPRSLSADENLYPDPDARVLIRRREESVLLLAGVTVNPTILSLNKLQDCIWLARYIYNYMTSGFRREYYVINDNCRNQNEETVVVKSVGHFGIHNEQDIFLHFQDKTNVLRPLLDEIKDSSAPHSIILRYLDDDILHAADWATMQLISLLYGEGFHIFRPDVPVDHDDYSVKILMKHHRCFGPFPV

SEQ ID NO: 1367 - protein, 533 aa, Magnaporthe oryzae
  misc_feature (1)..(533): Public GI ID no. 351642318
  misc_feature (1)..(533): Magnaporthe oryzae 70-15
  misc_feature (241)..(495): Pfam Name: p450 Pfam Description: Cytochrome P450
  misc_feature (1)..(533): Bit score of 259.1 for HMM based on sequences of Figure 9
  misc_feature (1)..(533): Functional Homolog Of SEQ ID NO. 1274
MTLYMVYLLEEAIKTPWTCALLAFVTAGYLLIDWPIVYPGIPLLGAGRGILGRRAAGKEFRLRGREMVREFAKTNEPFQVITETATKIFLPPRYAEEIKDVKELSFTQALAKELFAGYSGFEPIAAIADDANIIQTVARLNITTSLKYLTDHVSNEAGAALAEHLGNDTGTHIIPPSPYSRYDNNNSAQKDHWQEIPVKSFTRTLAARLSARVFVGPSLCSDKAWLAVSAGYAAQCHVASFKLQAWPRPLRRLVNWFLPECRALRSMVREARRILRPIVAERQGKPREDTISWLQTALRATSLTRYTVADFQLGLSLAAIHTTTELLTHALLDIVAAGPELIDDLRKEVVDVFGESSPDGAVFTKTRLYNMRLLDSAIKESQRVHTARLGGMGRVATRPTTLPSGLHIPAGAYTTVLLTPDADLFPSPETYNPRRFLDLRSRPGQDKNWQLVTTSPHHLAFGYGAHACPGRFLAAAEVKIALVRLLMGYDWRLQGGRGADVGLVSAHRVADPAARVWFRARESEVCFEGRDGL

SEQ ID NO: 1368 - protein, 504 aa, Neosartorya fischeri
  misc_feature (1)..(504): Public GI ID no. 119470770
  misc_feature (1)..(504): Neosartorya fischeri NRRL 181
  misc_feature (196)..(486): Pfam Name: p450 Pfam Description: Cytochrome P450
  misc_feature (1)..(504): Bit score of 375.9 for HMM based on sequences of Figure 9
  misc_feature (1)..(504): Functional Homolog Of SEQ ID NO. 1274
MDQVYLPQSLRTAVAVSFGVGLLYWVYRLLLQKTKSLKALDLPVLQSVGDQDIVKTLEDGHAKYPDTPFALGVPGQQVVVLPVSEIDTVKALPENQLSIKKHHYNQFLGEYSYMGTKADEFDDAMRYLLVRNTPAVLASFTAEIDYAMSTVLQVPPNTWTRVKPRSIMPKVATILSGRAFVGLPLSREPDWIESNVNYTQDVSRAWMVLRFYPHWIRPLVAPFLREVKTLEQNKALIGRKIAKLLADQEAQKLSPAKEKVPGGDMIDWFKSRYQTQGKTATAQQLTRDQLLATFASIYNLSNALTYVIFDLAAYPAVVDELREELDQVLGPNVGAESIDKTALPRLIKLDSFVRESQRLSPTSLVNIPRVVTDPNGLRLKTGHVIPPGYLVMVRAQPINQNSTLYPNPERFDAFRFARLRQQGGANENRWQHTSTGADNINFGHGIWACPGRFFASAEIKVVVAYVIRHYDLRLVEGRPHPKPKYGGLAIFPDAEAEVEFRPRV

SEQ ID NO: 1369 - protein, 393 aa, Trichoderma reesei
  misc_feature (1)..(393): Public GI ID no. 340514420
  misc_feature (1)..(393): Trichoderma reesei QM6a
  misc_feature (59)..(373): Pfam Name: p450 Pfam Description: Cytochrome P450
  misc_feature (1)..(393): Bit score of 351.2 for HMM based on sequences of Figure 9
  misc_feature (1)..(393): Functional Homolog Of SEQ ID NO. 1274
MLGAIKIDLNRNLGLFVGHVNHEVNVCFEQHFPSCKGIPCFCFITKSSVSHSPIDWTPVDLHETLLRVVAQASARIFVGYPMCRNEEWLECSTKFAIDVMTGGEKLKLWHPWLRPFAQYWIPEMRQIRGDHQRALDLLMPELKKRATEAKTTDTAPRQDMIEWMQQRAHKIGDKSFDYKELANLQMLTATAAIHTTRLAIIHALYDLAAHPEYIEPLRDEIREVTNDGSLQKQHLTQMKKLDSFMKESQRHSPPSVATYQRKAMIPIKLSNGFQIPAGTVVQCNTNILEETPSSWGDAHAFDGFRFHRMREAPEDANKFQFASPSYDSMQFGFGNDACPGRFFASNQIKIILSYILSRYDIKFEDSVKGRPKNLMFEVNVLADPTVKVLFKKL

SEQ ID NO: 1370 - protein, 506 aa, Aspergillus fumigatus
  misc_feature (1)..(506): Public GI ID no. 56609350
  misc_feature (198)..(488): Pfam Name: p450 Pfam Description: Cytochrome P450
  misc_feature (1)..(506): Bit score of 368.3 for HMM based on sequences of Figure 9
  misc_feature (1)..(506): Functional Homolog Of SEQ ID NO. 1274
MDQVYLPQSVRTAVAVSFGVGLLYWVYRLLLQKTKSLKALDLPVLQSVGDQDIVKTLEEGHAKSQYPDTPFALGVPGQQLVVLPVSEIDTVKALPENQLSIKKHHYNQFLGEYSYMGTKADEFDDAMRYLLVRNTPAVLASFTAEIDYAMSTVLQVPPNSWTRVKPRSIMPKVATILSGRAFVGLPLSREPDWIESNVNYTQDVSRAWMVLRFYPHWIRPLVAPFLREVKTLEQNKALIGRKIAKLLADQEAQKLSPAQEKIPGGDMIDWFKSRYQAQGKTATAQQLTRDQLLATFASIYNLSNALTYVMFDLAANPAAVDELREELDQVLGPNVGAESIDKTALPRLIKLDSFVRESQRLSPTSLVNIPRIVTDPNGLRLKTGHVIPPGYLVMVRAQPINQSPTLYPNPERFDAFRFARLRQQGGANENRWQHTSTGADNINFGHGIWACPGRFFASAEIKVVVAYVIRHYDLRLIEGRPHPKPKYGGLAIFPDAGAEVELKPRV

SEQ ID NO: 1371 - protein, 506 aa, Thielavia terrestris NRRL 8126
  misc_feature (1)..(506): Public GI ID no. 367046496
  misc_feature (134)..(478): Pfam Name: p450 Pfam Description: Cytochrome P450
  misc_feature (1)..(506): Bit score of 328.6 for HMM based on sequences of Figure 9
  misc_feature (1)..(506): Functional Homolog Of SEQ ID NO. 1274
MAGASSLLGAAPFEGLPVPVSYLAGAFALVFLLCLRVSKLVTRTVMPHLNPRKAFEFTDTRVKKHFVVNSRPMLESWFSAHPDQPARVIGDIGEVTVLPHRLANEIRNDPRLSFARWITQGFREGGRDSHIVQDVIMKDLTKHLNKVTEPLSQETALAVDELLPAADNEAWSPVVPREMLLRLVARVSSRVFLGEEVCRDPDWLRVTREYTVDGLKAAEDLRLWPAPLRYLVHWFLPSCSRARHHVREARRIINGVLEKRRLQKSLGEKVQFEDAIEWFEREAHGRPYDPAAAQLMLSFAAIHTTTELVTQVMTDLCKNPEIFGELRQEISQVLRAGGWNKNSLYNMKLLDSVIKESLRLKPTSIILMRRVATDNVQLSDGTFIPRGDTIAVSAQHMWDPEVYDKPREWDGRRFLRMRETQGQEHVAQLVSTSPEHLGFGHGQHACPGRFFASNEAKIILIHLLMKYDWRLAEGAPVPEVRYYAFTLLTDRATKLEYRRREPEIAI

SEQ ID NO: 1372 - protein, 496 aa, Aspergillus clavatus
  misc_feature (1)..(496): Public GI ID no. 121718870
  misc_feature (1)..(496): Aspergillus clavatus NRRL 1
  misc_feature (161)..(474): Pfam Name: p450 Pfam Description: Cytochrome P450
  misc_feature (1)..(496): Bit score of 392.5 for HMM based on sequences of Figure 9
  misc_feature (1)..(496): Functional Homolog Of SEQ ID NO. 1274
MIPLWPIILLFCSSVYFYFNPPGEKSNDIPTIRYSHFLPDFVNRLIFIVAAPQLIKRGYDKCKNGPYRIIKADGDLVILPAKYLAEIRHIPPSRLSGVDAQFENILGKYTNVLVESHLPTKTVIKRLTPGIGRVLPRILNELQYAFHVEVPDCDDKWVSVNLYDMILNILTRATSRVIVGETVCRNPKWLQTVTNYTVNLGITVMLLRPFPEFLRPMIAKVLPSVKKLRTQLRYVQKELFIPMILSRRYSEKNEPAYEKPDDFLQWMMDLAEDDFDKDPANLSQNLLIVMSLAVVHTSTMLMTHTLFDLIIRPEYAQSLREEIAATLPDGWDNATQAAFASQRRLDSFMRESQRFNPTGELSTHRMVKEDMVLSDGLVLKKGTHICFPSKPMGMDSSIVKDALTFDGFRWCDDPENKNASLVSIGPSNMHFGYGRQACPGRFFATNTNKAILSRLIADYEFKFEDGRKTRPNNILLGEQIMPNMYTKVLMRKREFV

SEQ ID NO: 1373 - protein, 340 aa, Ajellomyces capsulatus
  misc_feature (1)..(340): Public GI ID no. 240274084
  misc_feature (1)..(340): Ajellomyces capsulatus H143
  misc_feature (61)..(319): Pfam Name: p450 Pfam Description: Cytochrome P450
  misc_feature (1)..(340): Bit score of 292.2 for HMM based on sequences of Figure 9
  misc_feature (1)..(340): Functional Homolog Of SEQ ID NO. 1274
MVGSWHDIVLKKSALKIVAQLSSRVFLGEKLCRNPDWLQINISYTVNSYIAAQALRLWPEVIRPLVASFLPSCRKLRQEIEEARAIINPVLEERRQAKEAAIRVGKTPERYLDAMQWLEESARGRYYDPVVAQLSFSHAAIHTTSDLLTQVLFNLCGRDELTQKLRDEIITVTQAEGLKKTTLFKLKLMDSVLKETQRLKPVAVATMRRLAEEDIELSDKTFLPKGELIVVACDKMWDPDTYPNPSTFDPYRFVKLREKPGHEMSAQLVSTSPEHLGFGFGKHACPGRFFAANEIKIVLCHILLKYDVKLADGCEPRIRSNGLSLYADPIARISIRRRAD

SEQ ID NO: 1374 - protein, 518 aa, Botryotinia fuckeliana
  misc_feature (1)..(518): Public GI ID no. 154290200
  misc_feature (1)..(518): Botryotinia fuckeliana B05.10
  misc_feature (194)..(485): Pfam Name: p450 Pfam Description: Cytochrome P450
  misc_feature (1)..(518): Bit score of 680.9 for HMM based on sequences of Figure 9
  misc_feature (1)..(518): Functional Homolog Of SEQ ID NO. 1274
MPSTLVLGASALLLLAYVIRAILFRPKNLDFPIVGNPSDVDFRAALLEGTAKYPTTPYVLPSDPPTVVLPLTMHDELRNLPENKASFQKELSRMFYGEHTGIGIDTPPIIKVVKTDLNRHVASTIEPLQDESRFALDKELGTYDNWTQVIVYEKILKMIALLSGRVFVGRPLSRTEEWIDISTHFTEDVVLARESVAKYPAWLRSFAIPFLPEIRKLRQHKAVGAELLRPIIEGCIQRFREGKEDYEGDEFDDNQGTFVSWVMKWSDEKKKEDPFALAQHQLTLSFAAMHTTAMAVTHALFDLASHPQFIAPLREEIDQVLADDGWEDDGSGMKTLKKQSLPKLKKLDSLLKESQRLSPLDLVFNIRSTTSPIRLSTGETIPAGTRITFDAHTINMSGPNVSSLPHDPSNIPALDSPEIFSPFRWSTLREAPGNESKYQYVTTNKESVNFGHGNHACPGRFFAAIEIKVLLVEILKGWDFRLVGDKEGKGGEKPSNYIYNVTISPNPTAELEFKRRVI

SEQ ID NO: 1375 - protein, 479 aa, Schizophyllum commune
  misc_feature (1)..(479): Public GI ID no. 302693088
  misc_feature (1)..(479): Schizophyllum commune H4-8
  misc_feature (29)..(472): Pfam Name: p450 Pfam Description: Cytochrome P450
  misc_feature (1)..(479): Bit score of 361.2 for HMM based on sequences of Figure 9
  misc_feature (1)..(479): Functional Homolog Of SEQ ID NO. 1274
MLIEPQYSGIPVVGASGALSSYADARAFQQHAKEIIQEGVEKYPGSVFRVPTMDGWMVVVSGHQLVDELRAAREDELSFREAVEEVIHMKYTMGTTMEHHSEHLKIVQSDVTRNIAHCFADIYDEVQAVFNDVITFKEGEEWCTVPGFMTTMSMVSRVSNRYFVGLPLCRDKDFIASNMRFAIDVFQAAMKIRKYPAWMRPLIGSYLAPYKNQRKYLSGHIGAVVAQRIADDAKYGRDRADRPVDLISWILNHTPAELRTVEDVVLRVMSFNFAAIHTSTNTFANVLFHLAAEPHKYLQPLREEVEEVIAKHGWTKTAMREMYKLDSFLRESGRYNGLGCFSMTRKVVKKGGYTFSDGTKVPEGAMVGVASHATHWTEENYKDAHVFDGFRFSRMREADKTKYQMVNTDCEFLLFGHGYHACPGRFFAANELKAMLAHLVLHYDVQLEGGSRVKPENEWNTTSASPSRTAKVMFRKRQQ

SEQ ID NO: 1376 - protein, 514 aa, Arthroderma otae
  misc_feature (1)..(514): Public GI ID no. 296804446
  misc_feature (1)..(514): Arthroderma otae CBS 113480
  misc_feature (214)..(502): Pfam Name: p450 Pfam Description: Cytochrome P450
  misc_feature (1)..(514): Bit score of 477.1 for HMM based on sequences of Figure 9
  misc_feature (1)..(514): Functional Homolog Of SEQ ID NO. 1274
MDFDIVCKTLTSPAAVAGSICLAAAIYLYVFPRKQTLKFPVVLVEDGGMDSRAAVEYGYSEVDTHLQSFVLTANCLHWRQHPDQPFVLQSKTRTLVLLPPKYFDEIRSIPESKWSGRLSARNLFQSRYTRIGDNSPQVVHTVKTDLTRHIGKTLDALQDEMAFAAEQAIGACEDWTPVVPYPALLRVVSLISGRVLVGLPFSRTEQWIQLSINFTMLCFGAAQKYATYSSWLRPFIVPFLDVTGNIHRQRKAATALLAPVITEYKNSVESDGEPTNMIQWALASANDDSMTAEEQADIQLTLSMAAIHTTSTTVVLYCLYDLCAHPEYIEPLREEIKTVLAETDGRLVKRNMAKLRKLDSFIKESQRLSPPGLVAMQRIVVSDITLSDGSLLPRGTAVGVPNWGVTRDDRLWTNPETFDGFRFARLRDEAGAEHRHQFATAGPDSLSFGYGPQACPGRFFASNEIKVLLAHLLLNYDFRMEGNRPQNIIHELTVMPNRGVNVLFKKRARDTRNG

SEQ ID NO: 1377 - protein, 519 aa, Schizophyllum commune
  misc_feature (1)..(519): Public GI ID no. 302682570
  misc_feature (1)..(519): Schizophyllum commune H4-8
  misc_feature (79)..(502): Pfam Name: p450 Pfam Description: Cytochrome P450
  misc_feature (1)..(519): Bit score of 341.8 for HMM based on sequences of Figure 9
  misc_feature (1)..(519): Functional Homolog Of SEQ ID NO. 1274
MSGTPLLSSIQETVLELDPSAKAALAVGAATMAGYTIYKKVSGPDLSHIPAIGDSGWLSPYAGAREFQERAREMVQEGVDKYPGRAFRVPLMDSWIVVISGRNLVDELRAAREDELSFRQAAERIFQMKYTFGLNLDHHDSQLRVVQGDVTRNIGNCFGEIYDEIEAAFGDVIAFKGGQEWCTVNAHDAVMTLVNRVGNRYFVGLPLCRHEGFLNANMQFAHGVMQAAGILHKFPSFVRPLLGKYLSPYRAIRHDLLQHIGAVVAQRIRDDDELGTDRLNRPNDLISWVLSYLPPELRNVDEMVLRIMHINFGALHTSTSIFTYALLHLAAEPHLYLEPLREEAEEVIGRHGWGKTAMREMHKIDSFLREAGRFNGLGCLSLDRVVTKKGGYTFADGTFVPEGVRISVASHATHRDEDSYPNAHTFDGFRYSRLRESDPTKYQMVKTDCDYLLFGHGFHACPGRFFAANELKAMLAHIVLNYDVQLEGGSRVKPENEWFRDLQSPNHSARVMFRKRSLG

SEQ ID NO: 1378 - protein, 535 aa, Sclerotinia sclerotiorum
  misc_feature (1)..(535): Public GI ID no. 156045924
  misc_feature (1)..(535): Sclerotinia sclerotiorum 1980 UF-70
  misc_feature (197)..(524): Pfam Name: p450 Pfam Description: Cytochrome P450
  misc_feature (1)..(535): Bit score of 486.7 for HMM based on sequences of Figure 9
  misc_feature (1)..(535): Functional Homolog Of SEQ ID NO. 1274
MSENLEQSILRGYLELRWKNIALIAVFFTLVAIFIAWTRRPDEELLLQTLKDLDLPIVGKRPNVNVSEALEIGTTTYPNSPYVLPVDRVPIVILPNSVINTIKSLPEGKISFEKEVYTRHLAHLLLKKDQKIFSEPILDSIKQDLTRNISKTLDTLWDEVEFAFEKNVGILPEDDEGWKTVSVYGKVLHVVALLSGRVFVGAPLCRDEEWIKATITYTVILGATVGMLWKRPWWQRRILAPLYFRTLHGVQKKAEEMLKPLLEREATVDPSEWEKKTGEQNDGQLIRWLLSHTPQKSGKIDVKQLAHDQLTVSLAAIHTTSITISHLLYDLATYPEHVAPLREELESVIAEHKVAGGNGKLSKVELTKLWKMDSFIKESQRLNPPILVQMRRYLTSPLPLPSGHILPAGTYCGVDAQMANRTVPYYEASPITHQQEPFDTFDGFRFSKLRSVPGNENRYQFVTSSTESLNFGHGTHTCPGRFFASNEIKIALAEILLKWDVRLKPGEGRPANLYTDTNVMPNMKGEMQMRRRELL

SEQ ID NO: 1379 - protein, 500 aa, Serpula lacrymans
  misc_feature (1)..(500): Public GI ID no. 336377080
  misc_feature (1)..(500): Serpula lacrymans var. lacrymans S7.9
  misc_feature (133)..(487): Pfam Name: p450 Pfam Description: Cytochrome P450
  misc_feature (1)..(500): Bit score of 341.3 for HMM based on sequences of Figure 9
  misc_feature (1)..(500): Functional Homolog Of SEQ ID NO. 1274
MLEEISPLSFTFVTVIFLSIAISKYLRRPDVDSIPTVGPGGLLTSYWGALKFIFCAREMLQEGYANHKGMAFKIPGLFCWNVFLSGHKLVEEMRKAPEDHISVVERTSDILKPKYTLGPEIIHNPYHTPIILHQLTRSIAAKFPDMLDEIQTSFDDNIQLNGNEWTSVPAFGTVVKAMCRTSNRVLVGLPLCRDPDWNDLATGFALSVIKTAIIIDLFPNFMAPVVGTLLSSLPRSMRRGMKHLRPIIEERQKNLDEYGSDWDEKPSDLLSWLMDEAQGEERSAENLVKRMLAINFTAIHSSSMMFTQALYHLAENPQYVKPLREEVETIVEEEGWSKAALTKMRKVDSFMKETLRFDNFAFLSLPRKALKDFTFSNGIVVPAGCTVSVASMPTHYDSEIYENADVFNPFRFANEKQEGEQAWHQMVSTNADYLPFGHGRGSCPGRFFAASELKTMLAHIVVTYDIKFEDGAVRPTNITFGPASTPNMKAKLLFRKRVVE

SEQ ID NO: 1380 - protein, 441 aa, Serpula lacrymans
  misc_feature (1)..(441): Public GI ID no. 336365177
  misc_feature (1)..(441): Serpula lacrymans var. lacrymans S7.9
  misc_feature (23)..(420): Pfam Name: p450 Pfam Description: Cytochrome P450
  misc_feature (1)..(441): Bit score of 338.4 for HMM based on sequences of Figure 9
  misc_feature (1)..(441): Functional Homolog Of SEQ ID NO. 1274
MLQEGYTNHKGKAFKIPGLFSWNVFLSGSELVEEVRKASEDRLSARERISDILKLKYTLGHEIMDNPYHIPIILTQLTRNLAARFPDILDEIKASFDDNIQLNGHEWGSVPAFETVVRVVCRTSNRVFIGLPLCRDPDWNDLVSGFSLDVVKTAAMIDLFPEFMAPLVGRLLSKLPQSVQRGMRLLRPIIEERQKYLDDYGSDWYEKPNDMLSWLMDKAQGEERSAQNLTKRVLATNFTAIHTSSVIFTHALFHLAANPRYIKPLRDEVETIVEKEGWSKAALAKMRHVDSFLKETLRFDGLTFISMLRKAMTDFTFSDGTFIPAGCTVTVASSPMHHDSEIYADADAFVPFRFANEKQEGEQPWQQMVSTNPQYLAFGHGRNACPGRFFTATELKSMLAHVVVTYDVKFEDEGVRPTSVSFGTANSPDTKAKILFRKRVE

SEQ ID NO: 1381 - protein, 495 aa, Sclerotinia sclerotiorum
  misc_feature (1)..(495): Public GI ID no. 156045918
  misc_feature (1)..(495): Sclerotinia sclerotiorum 1980 UF-70
  misc_feature (137)..(487): Pfam Name: p450 Pfam Description: Cytochrome P450
  misc_feature (1)..(495): Bit score of 461.7 for HMM based on sequences of Figure 9
  misc_feature (1)..(495): Functional Homolog Of SEQ ID NO. 1274
MLHFADLGAISLANVNTVIAGCTVFALYYLFRFFNPKKLNFDAPTIGDASDLRSALTTGYKQCPDTPFLLPTAAHPTIILPIKYINEIKSLPPNKISFLEEFRDRYYGHYTAFANNVEGDAVTASVKVDLTQSIARALENMQVETELAFATEMPRNEDWTTVALYPIILRMVAKVSGRVMVGEPLCRNEKWIQISTTYTRDTFMGGRAMWTKNPLFRPIYALYSPELKKVRQHYTDAADFLRPIFNQRFKEMEQDGFKRPQDMIQWMIDNSGDNAKDATFQGRCQLLIAFAALHTTSGLLGNVILDLAARPHYIKALREELDANLPEGAQITKQILTKLQKMDSFLKESQRVNPLNLVTMNRKMMDTVQLSDGTILPKGSFVGMAAGSIAFDGRIFENPEEFDGFRFEKLRQQEGAENKYQLVTTGKDSLAFGHGTHACPGRFFASNEIKTMLIEFLRKYDFQLLPGAERPKNLKSDMSLVVDPTAKIQVRRRAM

SEQ ID NO: 1382 - protein, 523 aa, Chaetomium globosum
  misc_feature (1)..(523): Public GI ID no. 116178810
  misc_feature (1)..(523): Chaetomium globosum CBS 148.51
  misc_feature (134)..(473): Pfam Name: p450 Pfam Description: Cytochrome P450
  misc_feature (1)..(523): Bit score of 370.9 for HMM based on sequences of Figure 9
  misc_feature (1)..(523): Functional Homolog Of SEQ ID NO. 1274
MANVQAISEAVTARLPLILPTLAALLAVVLLQNVLSQKPLANLPVAGEHLGGDEKRRQAYLTKAADIYVDGYKKFTVIVVPPKFLGELRKLPDDVVSFDDAIAQIMHTKYTKLPTGETLVPHTVKASLTPALVRLNPTIAEEVQQSILQELPSCADWTSLNINRKLLRIVALVSGRIFIGAELSRSEEYLDAAINYTLELMEARRALEAMRPWLRPFLGSRLPEVKKLDQRRAQADKFLRPIVAARRQMQDSEKPDDMLQWIMDAQDKFRQYSTAELATIQLAISFAAIHTTTLTTTNVFYNLAAYPQYIPELRDEIRTVLAEHNGVFTSSALQAMKKLDSFLKETMRLDPAGSVSFSRKVNKTFTLSNGQVIPAGVVIEVPAAAVSHDPEVFPDADKFDPWRFSRLREEAREAGQVEAAAQNQFVSVNPTVLTFGFGRHACPGRFFAANEIKMIVANFVLEYDMALPEGVTERYPNLLFGSSPWRHSQLGQQYSHALPSPHIGVATGRTPTVSPLDVGQSGK

SEQ ID NO: 1383 - protein, 388 aa, Phaeosphaeria nodorum
  misc_feature (1)..(388): Public GI ID no. 169609220
  misc_feature (1)..(388): Phaeosphaeria nodorum SN15
  misc_feature (26)..(368): Pfam Name: p450 Pfam Description: Cytochrome P450
  misc_feature (1)..(388): Bit score of 337.2 for HMM based on sequences of Figure 9
  misc_feature (1)..(388): Functional Homolog Of SEQ ID NO. 1274
METKFTGVDSEDSNTVHTIKSDLTPALPRLNQAVCTEVDAAMREALPSCEDWTEVDINDKLLDIISKVSGRVFVGPDLCHDPEYLELGRNYTVYLMEALFAIKRTRPWLKSFVGHRLPEVKRLRDVEKKAIKFVQPIVRERLEAEKSDPNWQKPDDMMQWLINRYNKDGHVSVEHIAKCQLGLILAASHTTTMTTTNILYTLVSTPEYVEPLREEIRNAMHGNGGSITTRALQEMVKLDSYMKEVLRLYPAGLSSFSRRVMKGITLSNGQYLPPGATVQVPTAAIYTDSENYPDPDTFDGFRHSKLREGGTATDHSRNQFVTTNETNLGFGYGRHACPGRFFAANEIKMIVARLILNYDMKMPGDATERYPNVDIGRSCIPCPGAEKG

SEQ ID NO: 1384 - protein, 520 aa, Botryotinia fuckeliana
  misc_feature (1)..(520): Public GI ID no. 347829721
  misc_feature (111)..(506): Pfam Name: p450 Pfam Description: Cytochrome P450
  misc_feature (1)..(520): Bit score of 499.4 for HMM based on sequences of Figure 9
  misc_feature (1)..(520): Functional Homolog Of SEQ ID NO. 1274
MINFDETVARGREHQWLSLAILFVILYTASTLAQHLRAAKVPLVGRRFFLEPQFVTNFRFFRHAGEVLGDGYNRFKHTTFKFIRADAEMLVLPAKYVNELRNLPNTIASPTLAHVHNLMGRHTNMDVILRNNLHFRTLQEKVTPNLGSVTVPMQEELNHALQYDFPNNEDEWVTIKPYHTILRLVSRLSARVFLGTPLCRNEQWLEISTEFTENVFISLVILRLFPMWLHGLISMILPSAWKGSAYVRQAKRLLVPEVKRRQQEINAGKQGSAEHRNILSWMIEIGKENEKQPADLAHLEVIMSLASIHTSQMNAVHVLYDLAAHPGYIQDLRAEIKQIIETDGPWMEWKKTSFSKLRLLDSFMKESQRLNPPTQLSYHRILLENHTLNDGTILHKGSHVCMAVTAIQNDEAVTPDPSVFDGFRYYKMRQREDEGHLHQFATTEPTNLNFGHGKYACPGRFFAALEIKIILVRLIMDYDFKFKDSQIRPANLFAHEFIFPNPEGEFLVKRRRAEERLQLV

SEQ ID NO: 1385 - protein, 504 aa, Aspergillus fumigatus
  misc_feature (1)..(504): Public GI ID no. 159124430
  misc_feature (1)..(504): Aspergillus fumigatus A1163
  misc_feature (196)..(486): Pfam Name: p450 Pfam Description: Cytochrome P450
  misc_feature (1)..(504): Bit score of 376.5 for HMM based on sequences of Figure 9
  misc_feature (1)..(504): Functional Homolog Of SEQ ID NO. 1274
MDQVYLPQSVRTAVAVSFGVGLLYWVYRLLLQKTKSLKALDLPVLQSVGDQDIVKTLEEGHAKYPDTPFALGVPGQQLVVLPVSEIDTVKALPENQLSIKKHHYNQFLGEYSYMGTKADEFDDAMRYLLVRNTPAVLASFTAEIDYAMSTVLQVPPNSWTRVKPRSIMPKVATILSGRAFVGLPLSREPDWIESNVNYTQDVSRAWMVLRFYPHWIRPLVAPFLREVKTLEQNKALIGRKIAKLLADQEAQKLSPAQEKIPGGDMIDWFKSRYQAQGKTATAQQLTRDQLLATFASIYNLSNALTYVMFDLAANPAAVDELREELDQVLGPNVGAESIDKTALPRLIKLDSFVRESQRLSPTSLVNIPRIVTDPNGLRLKTGHVIPPGYLVMVRAQPINQSPTLYPNPERFDAFRFARLRQQGGANENRWQHTSTGADNINFGHGIWACPGRFFASAEIKVVVVYVIRHYDLRLIEGRPHPKPKYGGLAIFPDAGAEVELKPRV

SEQ ID NO: 1386 - protein, 526 aa, Gibberella intermedia
  misc_feature (1)..(526): Public GI ID no. 42661492
  misc_feature (176)..(504): Pfam Name: p450 Pfam Description: Cytochrome P450
  misc_feature (1)..(526): Bit score of 1129.9 for HMM based on sequences of Figure 8
  misc_feature (1)..(526): in Figure 8
MTNHSSSYYYEFYKDHSHTFRRSMSENTLISSCLALATCAILLSIQWLKPQPLIMVNGRKFGELSNVRAKRDFTFGARQLLEKGFKMSPDKPFRIMGDVGELHILPPKYAYEVRNNEKLSFTMAAFKWFYAHLPGFEGFREGTNESHIMKLVARHQLTHQLTLVTGAVSEECALVLKDVYTDSPEWHDITAKDANMKFMARITFRVFLGKEMCRNPQWLRITSTYAVIAFRAVEELRLWPSWLRPVVQWFMPHCTQSRALVQEARDLINPLLERRREEKAEAERTGEKVTYNDAVEWLDDLAREKGVGYDPACAQLSLSVAALHSTTDFFTQVMFDIAQNPELIEPLREEIISVLGKQGWSKNSLYNLKLMDSVLKESQRLKPIAIASMRRFTTHNVELSDGVILPKNKLTLVSAHQHWDPEYYKDPLKFDGYRFFNMRREPGKESKAQLVSATPDHMGFGYGLHACPGRFFASEEIKIALSHILLKYDFKPVEGSSMEPRKYGLNMNANPTAKLSVRRRKEEIAI

SEQ ID NO: 1387 - protein, 526 aa, Gibberella intermedia
  misc_feature (1)..(526): Public GI ID no. 122938156
  misc_feature (189)..(504): Pfam Name: p450 Pfam Description: Cytochrome P450
  misc_feature (1)..(526): Bit score of 1128.4 for HMM based on sequences of Figure 8
  misc_feature (1)..(526): Functional Homolog Of SEQ ID NO. 1386
  misc_feature (1)..(526): in Figure 8
MANHSSSYYHEFYKDHSHTVLTLMSEKPVILPSLILGTCAVLLCIQWLKPQPLIMVNGRKFGELSNVRAKRDFTFGARQLLEKGLKMSPDKPFRIMGDVGELHILPPKYAYEVRNNEKLSFTMAAFKWFYAHLPGFEGFREGTNESHIMKLVARHQLTHQLTLVTGAVSEECALVLKDVYTDSPEWHDITAKDANMKLMARITSRVFLGKEMCRNPQWLRITSTYAVIAFRAVEELRLWPSWLRPVVQWFMPHCTQSRALVQEARDLINPLLERRREEKAEAERTGEKVTYNDAVEWLDDLAREKGVGYDPACAQLSLSVAALHSTTDFFTQVMFDIAQNPELIEPLREEIIAVLGKQGWSKNSLYNLKLIDSVLKESQRLKPIAIASMRRFTTHNVKLSDGVILPKNKLTLVSAHQHWDPEYYKDPLKFDGYRFFNMRREPGKESKAQLVSATPDHMGFGYGLHACPGRFFASEEIKIALSHILLKYDFKPVEGSSMEPRKYGLNMNANPTAKLSVRRRKEEIAI

SEQ ID NO: 1388 - protein, 524 aa, Ajellomyces capsulatus
  misc_feature (1)..(524): Public GI ID no. 240282093
  misc_feature (1)..(524): Ajellomyces capsulatus H88
  misc_feature (100)..(504): Pfam Name: p450 Pfam Description: Cytochrome P450
  misc_feature (1)..(524): Bit score of 1011.2 for HMM based on sequences of Figure 8
  misc_feature (1)..(524): Functional Homolog Of SEQ ID NO. 1386
  misc_feature (1)..(524): in Figure 8
MATLEPTTGYIAELISTSNLPSVTFVVTAVTLAVFYTLQRRKSTVPLINPKRWFEFSDYRIKQEFVHNAIPLVKQGFAATGNKPFRILADSGELTVLPPDVANEIKSNDHMSFELSTAKQFFGHLPGFEVFNATGMNTKVSKSIVQRQLTTHLNKVTKPLSDEASLSLQEILTDNKEWHEITLKNEVLQIIARLSSKVFTGDELCHDKRWLDITVNYTIMAFAAADSLRMWPPYLRSIVHWFLPKCRASRAEVARARTVIEPILKRRAEQKAALAAQGKKAPEINDAIEWFTTATTIEGFTLDPVIAQLGLSLAAIHTTSDLSTQVILDIASHPEIIEPLRKEMIESLSEGGWKKNSLYKLKLLDSVIKESQRMKPIASISMSRLTTTNVSLSDGTFIPRNTATAVSSHRMWDPSIHTNPDQWDGYRFYNKRQEPGQENLSQLVSTSPDHLAFGHGQHACPGRFFAANEIKVFLCHLLLKYDLKIVEGSMIKPFPYSFSMNANPFAPLMIRRREDVIDLDALDA

SEQ ID NO: 1389 - protein, 526 aa, Gibberella fujikuroi
  misc_feature (1)..(526): Public GI ID no. 3549879
  misc_feature (189)..(504): Pfam Name: p450 Pfam Description: Cytochrome P450
  misc_feature (1)..(526): Bit score of 1129.0 for HMM based on sequences of Figure 8
  misc_feature (1)..(526): Functional Homolog Of SEQ ID NO. 1386
MANHSSSYYHEFYKDHSHTVLTLMSEKPVILPSLILGTCAVLLCIQWLKPQPLIMVNGRKFGELSNVRAKRDFTFGARQLLEKGLKMSPDKPFRIMGDVGELHILPPKYAYEVRNNEKLSFTMAAFKWFYAHLPGFEGFREGTNESHIMKLVARHQLTHQLTLVTGAVSEECALVLKDVYTDSPEWHDITAKDANMKLMARITSRVFLGKEMCRNPQWLRITSTYAVIAFRAVEELRLWPSWLRPVVQWFMPHCTQSRALVQEARDLINPLLERRREEKAEAERTGEKVTYNDAVEWLDDLAREKGVGYDPACAQLSLSVAALHSTTDFFTQVMFDIAQNPELIEPLREEIIAVLGKQGWSKNSLYNLKLMDSVLKESQRLKPIAIASMRRFTTHNVKLSDGVILPKNKLTLVSAHQHWDPEYYKDPLKFDGYRFFNMRREPGKESKAQLVSATPDHMGFGYGLHACPGRFFASEEIKIALSHILLKYDFKPVEGSSMEPRKYGLNMNANPTAKLSVRRRKEEIAI

SEQ ID NO: 1390 - protein, 527 aa, Colletotrichum higginsianum
  misc_feature (1)..(527): Public GI ID no. 380486272
  misc_feature (240)..(503): Pfam Name: p450 Pfam Description: Cytochrome P450
  misc_feature (1)..(527): Bit score of 440.0 for HMM based on sequences of Figure 8
  misc_feature (1)..(527): Functional Homolog Of SEQ ID NO. 1386
MLVRSLLESIEGFRTGLWPDTRQHAPWLWPYAALILGVAVFGLLFRRKRSSLRVYNPKKWWELTNMRSRRDFDTHGPDWIQAWFSKNDEPIRFVVDSGYCSILPSSMADEFRKMKELCMYKFLATDFHSHLHGFDGFKEVTRDAHLATKVVLGQFQTQANKYVVPLSLKAKSAISDVMGDNKEWHTTHFYNQGLDLIVRTVEFIMVGEELSSNPEWLDISKKHALTMAVHARQLRLWSKLLRPFVHYLSPLGKNLRDQVDKTRSLVEPIVQKRRSERAACLAKGVKPPVYVDSIQWFEEAANGDWYDAAGAQLAMHFAGIYATSDLLIGSLVDICRHPEIIEPLRQEIRTCIAEGGWTPASLFKMKLLDSCMKETQRIKPVECATMRSYALRDVTFSNGTFIPKGELVAVAADRMNNPNVWEEPEKYDPYRFMRMRQDPEKAASALLENTSADHVGFGWNPRACPGRFFAAKEVKILLAHLLIQYDFKPVPGDNLELFRHSFSVRIHPNTRLMVRRRDEELPLPGSQ

SEQ ID NO: 1391 - protein, 514 aa, Neurospora crassa CAB91316
  misc_feature (156)..(493): Pfam Name: p450 Pfam Description: Cytochrome P450
  misc_feature (1)..(514): Bit score of 620.7 for HMM based on sequences of Figure 8
  misc_feature (1)..(514): Functional Homolog Of SEQ ID NO. 1386
MERLDIKSITDPSATPFSYLVTAFLLAVVVYSLQGPRFPKNIKHLNPKGPLEFSDTRPKKEFVYGSRQMLANWFKANPNKPCRVISDFGEAIVLPPRMANEIKNDDRLSFTRWTYKAFHGHLPGFEGFGEASRESHIVQEVIMRDLTKYLNKVTEPLAQETSMAMEANLPKAANGEWSTINLRSKILPIVARISSRVFLGEELCRNEEWLKVTQQYTIDGFGAAEDLRLWPAALRPIVHWFLPSCQRARADVRVARSILDPVLKKRRQEKAANGGKAEHDDAIEWFERTAKGKYYDPAVAQLVLSLVAIHTTSDLTCQVMTNLMQNPEFIAPLREEMIQVLSEGGWKKTSLYNMKLLDSVIKESQRVKPTGVASMRRYAEKDVTLSDGTFIPKGGFVAVSAHDMWNSEVYEQAEKWDGRRFLRMRETPGAGKENVAQLVSTAPEHLGFGHGQHACPGRFFAANEIKIALVHLLLNYEWRLPEGSDPKIRTFGFSMGVDPSLKVEYKGRQPEIEL

SEQ ID NO: 1392 - protein, 481 aa, Aspergillus niger
  misc_feature (1)..(481): Public GI ID no. 317030883
  misc_feature (1)..(481): Aspergillus niger CBS 513.88
  misc_feature (157)..(449): Pfam Name: p450 Pfam Description: Cytochrome P450
  misc_feature (1)..(481): Bit score of 425.7 for HMM based on sequences of Figure 8
  misc_feature (1)..(481): Functional Homolog Of SEQ ID NO. 1386
MFAANIISYLAKLVPPRWIWAPILAAVFFWLLSAPSLKTSLPVINQRRRFEIGSLGSLKRFFKDAHGLVRAGLSQGSAFYLYSEFGPKIVLASKYADDFRSHHALSLLDAVAEEYHAHIRGFDPFNRDPAIIIDMVRMKLTPHLELKPNMLDLISRLTSRVFLGEKLYRNPDWHRVTAGYAVHTFMSALFLRMFPRCTRPFVANLLPFCRKMRKELQEAKDIITPVVEERRTAKQDAIRQGKEPERYVDAMQWMEECAKGRPYDPTLAQISLTLATIHTTSDLLTQTLFYLAERDEIIVALRNEVITVLQGDGWSKSTFNNLKLMDSILKESQRLKPHNMVAMRRFAQEDVTLSDGTVLPKGSISVLTTEAMRDPTIYPDPETFDAYRFLKLRETPGYETMAQAVSTTPQHLAFGLGKHACPGRFFAIALLKIILCHILLEYDFKIADGWSPTVRKYGFIWQADPVAKVSVRRRKEEFTIL

SEQ ID NO: 1393 - protein, 524 aa, Ajellomyces dermatitidis
  misc_feature (1)..(524): Public GI ID no. 239614263
  misc_feature (1)..(524): Ajellomyces dermatitidis ATCC 18188
  misc_feature (99)..(497): Pfam Name: p450 Pfam Description: Cytochrome P450
  misc_feature (1)..(524): Bit score of 870.5 for HMM based on sequences of Figure 8
  misc_feature (1)..(524): Functional Homolog Of SEQ ID NO. 1386
MAALEPKSGYLAELVSTSNLPSVTFVVTALTLILFYTLQRRKPNVPLINPKRWFEVSDQRIKQEFVHNAIPMIEKGFAVTGNKPFRVQADSGEVTVLPPNVANEIKNDARLSFELNTSRAFFGHLPGFEVFNTDGCNMRVAKSIVQRQLTTYLAKVTKPLSDEATLSLREILTDNKEWHQITLKNELLQIIARLSSKVFLGDELCHDERWLDITINYTLHAFAAADSLRMWPSYLRDIVHWFLPRCRASRAEVARARTVIGPILKKRAEHKAALAPQGKEPPGLNDAIEWFENASRAEGTYVDPVIGQLGLGLAAIHTTSDLSTQVILDIASHPEIIEPLRKEIIEALREGGWKKTSLYKMKLLDSVIKESQRMKPITSISMGRVATTDITLSDGTTIPKDTHTVVSSHSMWDPRVHTNADQWDGYRFYNMRQVPGQENSSQFVSTSPDHLAFGHGQHACPGRFFAANEVKVLLCHLLLKYDLKVVEGSMIKPFRYSFSISANPIAPLMIRRREDVIDLDSLEA

SEQ ID NO: 1394 - protein, 509 aa, Fusarium longipes
  misc_feature (1)..(509): Public GI ID no. 270160669
  misc_feature (147)..(481): Pfam Name: p450 Pfam Description: Cytochrome P450
  misc_feature (1)..(509): Bit score of 465.3 for HMM based on sequences of Figure 8
  misc_feature (1)..(509): Functional Homolog Of SEQ ID NO. 1386
MMALISNLPIPAYSLCVVVFIILTLAIRRILAPKPSAPLLNPRRFYEFSDDGPVSRVLHTTRQTIENWFDKNPEKPMRLICDLGEITVLPPSMADEIKKDARLSFIKASNDSAFHISIPGFEPYREGGKHEAALVKNVVHGHLKKTLNRITLPLAQETYLAIDEYLGSSQEWHKIPLNETMLPLITRISTRVLLGEDFCRNEEWIRIASSYSVISTTVAGRLRRWPQYLRYIVSLLSPQCKELRKLVKDSHSLIDPIIEKRRSDEKGTVYNDSLEWFEKTAKAAYDPADTQLFLTAVSIHTTVDLLCQALEDICAHPEIIGPLQNEIRSVIKEEGWNTKALYKMKLLDSALKETQRLKPVQIASMMREALVDITLEDGIFIPKGHQLAVSCHNMRDDKIYPNASEWDGYRFFRERQEADAAREDKIQLSSTSVEHMGFGYGEHACPGRFFAAKEVKIVMMYLLLNYEWRIPEGSKPNPVTCCTIWVTDPTFELEVRKKSSEDPALELAY

SEQ ID NO: 1395 - protein, 526 aa, Neosartorya fischeri
  misc_feature (1)..(526): Public GI ID no. 119469260
  misc_feature (1)..(526): Neosartorya fischeri NRRL 181
  misc_feature (78)..(489): Pfam Name: p450 Pfam Description: Cytochrome P450
  misc_feature (1)..(526): Bit score of 428.0 for HMM based on sequences of Figure 8
  misc_feature (1)..(526): Functional Homolog Of SEQ ID NO. 1386
MALISELLQSPYFLQGIAVSLLLVVVSNFYRKLVDGFPYRNIPLVGRSRWEITNSKAKERFVASAKALFAQGFSQGKTVFQMMFSHSPMIVLHPRYMDEIKSHPHLTFDEANRKAFFGAKLPGFEPFGLDKEGIALDVINKKLTHTLGSLTISLSRESAAVLKETLPPKSDEWQSLVFAQEIPYIVARLSSLVFMGEKVCRDKEWLHVSVNYTIDAFGAARDLRLWPSITQSLVHWFLPSTRRVRKHISVAKKIVQKEIEKRELIRQGKLLEYSPLKPDDALDWFREVAAGRPYDMTKSQISLSLAAIHTTSNLLTNVMYDLIAYQEYIQPLRDEIVAVVKEEGCLKKTSLTKLKLMDSFMKETQRLNPVSIASLQRYALADITLSDGTFIPKGAMLVISAHTMNDESIYPHADTFDGYRFYNKRKVPGNEHRYQFVTTSNEHFAFGHGLHACPGRFFAANEVKILLIHLLMKYDWKFAEDRGRPQSLMHGTEIICDPNVKLLYKARTPEIDLSKLGELPTDSPSV

SEQ ID NO: 1396 - protein, 427 aa, Talaromyces stipitatus
  misc_feature (1)..(427): Public GI ID no. 242795506
  misc_feature (1)..(427): Talaromyces stipitatus ATCC 10500
  misc_feature (10)..(402): Pfam Name: p450 Pfam Description: Cytochrome P450
  misc_feature (1)..(427): Bit score of 478.8 for HMM based on sequences of Figure 8
  misc_feature (1)..(427): Functional Homolog Of SEQ ID NO. 1386
MDTDMARTLILSPEYANEIRSDPRLSFRKHNTKDFLGHLFTFELFQDRGKFGEKINDMVRTKLTQSLGLITKDVSNEMADVIHHQWSEDADWHSINLKNTMVEVVAQVSSRVFLGPGLCRNKEWLRITIDYTLLIFDAIRTVKRYPKFLHPLVQWVLPEPRKVRFHMAEARRIIQPVIDQRKAEMASDKATKHNDAIQWLLEISTGTEYDIALAQLALSMAAIHTTGDMITQVIYDICEHPELIQPLREEIIAVMGTDEFKRTSLYNLKLMDSVMKESQRLKPAGMISMRRVATEEVILHDGRRIPKGSMVAISGHWSWDETFYENPEQFDGYRFLKLSKSPATEHMSHFVSTSPQHLAFGYGKNACPGRFFAANEAKIALVHILLKYDFKLDETTPPPKVVKIGWMMASDSQAKLLVRRRKEFSLD

SEQ ID NO: 1397 - protein, 521 aa, Paracoccidioides brasiliensis
  misc_feature (1)..(521): Public GI ID no. 226291700
  misc_feature (1)..(521): Paracoccidioides brasiliensis Pb18
  misc_feature (164)..(490): Pfam Name: p450 Pfam Description: Cytochrome P450
  misc_feature (1)..(521): Bit score of 687.4 for HMM based on sequences of Figure 8
  misc_feature (1)..(521): Functional Homolog Of SEQ ID NO. 1386
MATREVMSVYLAELMSTPNLPSVTFIVTAVTLLSIYMLQRPKTNVPLLTLKKRFEFSNKRVKQNLIRDAIGVVKQCFATTGNKPFRMITESGEEITILPATFANEIRNDNRLSFEEQIHRVGNRLLRPEQFSADVISWQNFFGHLPGFEVFRVNSENMKLMKSVVQRQLTTNLEWNKITIKEKFLQIVARVSSKVFLGDELCHDPKWLDITIAYTLVAFGAAEALRLWPAWTRDFVHWFLPECRQSRAEVKKARKVIQPFLKKRAADKAALAAQGKKPPVIHDAIEWFEQASGEVEGLYDPVVVQLGLSLAAIHTTTDLIIQVILGLVEHPEIIEPLRKEIFDALSEGGWKKTSLYKMKLLDSVIKESQRMKPISSITMSRVTLDNITLSDGTTIPKNVMTAVSSNRMWDPTVYADPDQWDGYRFYNMRHQPGQENTAQLVTTSPDFLAFGHGQHSCPGRFFAGNEIKVILCHLLLKYDLKLVEGAYTKPFSVSHSLYANPFAPVMIRRRDEGIDIDSLGS

SEQ ID NO: 1398 - protein, 528 aa, Aspergillus terreus
  misc_feature (1)..(528): Public GI ID no. 4959945
  misc_feature (149)..(496): Pfam Name: p450 Pfam Description: Cytochrome P450
  misc_feature (1)..(528): Bit score of 453.4 for HMM based on sequences of Figure 8
  misc_feature (1)..(528): Functional Homolog Of SEQ ID NO. 1386
MTVDALTQPHHLLSLAWNDTQQHGSWFAPLVTTSAGLLCLLLYLCSSGRRSDLPVFNPKTWWELTTMRAKRDFDANAPSWIESWFSQNDKPIRFIVDSGYCTILPSSMADEFRKMKELCMYKFLGTDFHSHLPGFDGFKEVTRDAHLITKVVMNQFQTQAPKYVKPLANEASGIITDIFGDSNEWHTVPVYNQCLDLVTRTVTFIMVGSKLAHNEEWLDIAKHHAVTMAIQARQLRLWPVILRPLVHWLEPQGAKLRAQVRRARQLLDPIIQERRAERDACRAKGIEPPRYVDSIQWFEDTAKGKWYDAAGAQLAMDFAGIYGTSDLLIGGLVDIVRHPHLLEPLRDEIRTVIGQGGWTPASLYKLKLLDSCLKESQRVKPVECATMRSYALQDVTFSNGTFIPKGELVAVAADRMSNPEVWPEPAKYDPYRYMRLREDPAKAFSAQLENTNGDHIGFGWHPRACPGRFFASKEIKMMLAYLLIRYDWKVVPDEPLQYYRHSFSVRIHPTTKLMMRRRDEDIRLPGSL

SEQ ID NO: 1399 - protein, 524 aa, Monascus pilosus
  misc_feature (1)..(524): Public GI ID no. 74275563
  misc_feature (151)..(498): Pfam Name: p450 Pfam Description: Cytochrome P450
  misc_feature (1)..(524): Bit score of 467.1 for HMM based on sequences of Figure 8
  misc_feature (1)..(524): Functional Homolog Of SEQ ID NO. 1386
MTVPTDTVSRRLQSLAWSDIKQHAPWLPSSRTLVSGFLCLILLQILYSRGRKSDLRVYNPKKWWELTTMRAKREFDANAPAWIEAWFSKNDQPLRFIVDSGYCTILPSSMADEFRKMKELCMYKFLGTDFHSHLPGFDGFKEVTRDAHLITKVVMNQFQTQAAKYTKPLADEASATIADIFGDNKEWHTAPVYNECLDLVTRTVTFIMVGDKLAHNEEWLDIAKHHAVTMAIQARQLRLWPVILRPIVHWLEPQGAKLRAQVRRARQLLEPIIQERRAEKAKCLAQGIEPPRYVDSIQWFEDTAKGQWYDAAGAQLAMDFAGIYGTSDLMIGGLVDIVRHPHLIEPLRNEIRTVIGEEGWTPASLYKLKLLDSCLKESQRVKPVECATMRSYALQNVTFSNGTFVPKGELVAVAADRMSNPEVWPEPKKYDPYRYMRLREDPDKAFSAQLENTNGNHIGFGWHPRACPGRFFASKEIKIMLAFLLIRYDWKLVPNEPLQYYRHSFSVRIHPATKLMMRRRDEDL

SEQ ID NO: 1400 - protein, 529 aa, Muscodor strobelii
  misc_feature (78)..(506): Pfam Name: p450 Pfam Description: Cytochrome P450
  misc_feature (1)..(529): Bit score of 621.4 for HMM based on sequences of Figure 8
  misc_feature (1)..(529): Functional Homolog Of SEQ ID NO. 1386
MSFPNDLPSDGGLSILSQETTKISYLVLAVSLAFFYFLRRAKATNYPIVNPRKWFEFSDARVKKDFMISARTLVHEGLKKYPGRPFKVNTDMTDMIVLPNNYADEVRNIRELSFPASIRKHFYSDLKSFESMAPAGGNGSQLAKSVVQRQLTHQLAYVTQPLSEECATVLQEVLTDNKDWHELPSLMQSTLMIVYRLSSRVLLGDELCHDEYWRKIVMEHTTTVMDAVLQVRMWPSWLRPIVHWFLPSCRESRKQLRRAREIIDPVLEKRRELRKELIAKGESPKMMNDGLEWLEENSKGENYDAAILQLALSMVAMHTTTDLLTQSLLDIMTHPEIIGSLRKEIIETMGQGRWDRTSLQNLKLLDSVLKETQRMKPIEMATMKRVALKDIKLSDGSQIPKGGDMIVYAGNHWDPSVHEDPNTWDPYRFYNRRQAAKTEKEEKQYLLSSTSPDHMAFGHGQHACPGRFFVADEIKIALCHLLLKYDWKLAEGCNADSMTMGFTLLANPIAKVMVKRREEEISLAGRIDS

SEQ ID NO: 1401 - protein, 504 aa, Aspergillus fumigatus
  misc_feature (1)..(504): Public GI ID no. 159124063
  misc_feature (148)..(490): Pfam Name: p450 Pfam Description: Cytochrome P450
  misc_feature (1)..(504): Bit score of 399.8 for HMM based on sequences of Figure 8
  misc_feature (1)..(504): Functional Homolog Of SEQ ID NO. 1386
METLDAIQLPYLGVVGASLIVILGIILLFPLGSDPFITINQHPRDLFQTKAKQQFEYNAAALLNEGLQTGHSAFRLVTNMVTYLILKDQYAEEIKNDSRFGAHEAVDPVLLVDLPGLESMFQGSLHNQVPPMAVRALNKELVHLTPSLSEEAMNCLQTRWTDSTEWHGVSIPETVLALIAQMTTRALLGPELCRNPEWLDIAKSFTTNRAIAVAAVQSWPSFLQPVIHWFLPPCRALRRQIQCARNIILPALERERRAYCSDQPTKREFSNLVFIDQYAKGARYDATMAQLRIIAVAFQTTSDLVEKVIARLCKHPELIEPLREEVVSVVGNRGLHRHSLRKLTLMESVMKETQRLEPAVIIGMFRLAKEKVTLKDGTVVPKGTNIAFANDLRFDPEMYLEPETFDGYRFQRMREDPAKIDLAPFTKTRMSHLAFGHGKHACPGRFLACDEAKLILCHILLNYDIRAVEGSPPELRARGMFVQLDPGAMMSVRRRRGTETAPHG

SEQ ID NO: 1402 - protein, 444 aa, Myceliophthora thermophila
  misc_feature (1)..(444): Public GI ID no. 367035976
  misc_feature (1)..(444): Myceliophthora thermophila ATCC 42464
  misc_feature (74)..(419): Pfam Name: p450 Pfam Description: Cytochrome P450
  misc_feature (1)..(444): Bit score of 554.3 for HMM based on sequences of Figure 8
  misc_feature (1)..(444): Functional Homolog Of SEQ ID NO. 1386
MLDAWFREHPNQPARIIGDAGEVIVLLPHLTNEMRNDPRLSFAGWIVKNFLAHIPGFEGFREGSRDSQIVQEVIMKDLTKYLNKITEPLSEETALAVNELYPADDDQERHTISPRERLLRLVARVSSRVFLGEEICRNEAWLRVTREYTVDAFGAAEELRLWPAPLRALVHWFLPSCRRARADVAEARRIIGAVLDKRRLQKLRGEKVEYDDAIDWFEREARGREYDPTVAQLTLSMAAIHTTTELVTQVMSDIAQDPDILDELRHEMVQVLRDGGWKKTSLYNMKLLDSVLKESLRLKPTGIISMRRLASDNIRFSDGTSIRKGSMVAVTARKHWDAGVYEKPEAWDGRRFLRMRETPGREHVAQMVSTGPDYLSFGHGQHACPGRFFAANEAKVVLIHLLLKYDWRLSPDAPRPRIRHYGWTLRADPTTTMQYRRRRPEIDL

SEQ ID NO: 1403 - protein, 518 aa, Aspergillus fumigatus
  misc_feature (1)..(518): Public GI ID no. 159130277
  misc_feature (1)..(518): Aspergillus fumigatus A1163
  misc_feature (152)..(496): Pfam Name: p450 Pfam Description: Cytochrome P450
  misc_feature (1)..(518): Bit score of 486.1 for HMM based on sequences of Figure 8
  misc_feature (1)..(518): Functional Homolog Of SEQ ID NO. 1386
MVSSFSSKRLGDTMDNLALGSNWAGGVAIVLFLAPLALHLVSSYLFPSTSTVINSGRAWDIFRTTAKKRFRSDAARLLQNGFEKSPDAFRILTDNGPLLVLSPRYAREVRSDDRLSLDHFIASEFHPDIPGFEPFKLILDPRNPLNTILKTSLTQALEDLSVEVADALSTALTDDSEWHEISPCQTALKLVAQMASKAFIGPEKCRDPKWHNVIITYTHNVYRAAQALHFWPKFLRPIVARFLPACQTLQAQIAEAREILEPLVAQRRADRACRAAQGKPVPSRADVIDWLEDSHGDQPYDPVAAQLLLSFAAIHGTSNLLAQALMDLCTAPDLIRDIRAEITSVLGDAGLTRAALYRLKLMDSALKESQRLAPNRLLSMGRIAQSDMHLSDGLRIPRGTTLMVSAHAMWEPEIYPDPRRYDGYRFYKLRQVPGQEGQHQLVSATEKHMGFGYGKHACPGRFFAAAEIKVALCHILLKYDLEHRGGGPPPRVWSQGIHLFPDPTARIRVRRRKEEISL

SEQ ID NO: 1404 - protein, 529 aa, Aspergillus nidulans
  misc_feature (1)..(529): Public GI ID no. 67904522
  misc_feature (1)..(529): Aspergillus nidulans FGSC A4
  misc_feature (248)..(519): Pfam Name: p450 Pfam Description: Cytochrome P450
  misc_feature (1)..(529): Bit score of 438.2 for HMM based on sequences of Figure 8
  misc_feature (1)..(529): Functional Homolog Of SEQ ID NO. 1386
MAMGNPELRTHFFRSSHEPGIPNSLRFPNGFLVTCGLPWLLLLFSVTIILFHPLRKKSDLPLINPGKGRIGILRGYRSRKTFTTELPRLVADGLSKASAFRIAAPDGVNIVLAPSYAHEIAEHPDLNPGPIAGDEFNSHINGFEVFAQLGTSDVISESVRTRLTRQLTKLTPLLTSETPLLLQSQWKDAPDWVEVSPHETALFILSRLSSLVFVGDDLGRNPDWIRILTSYNTEAFAAAEELNLWPQILRPLIARLKPSCRQLRRYIRDARALLVPVLEQRRHAQSQGDRREYNDAIEWLDETSRSTGQPYDPILSQMLLAIGSFHTSSDLLGQVLLDLCMRPDWKVLVRELRKEIISSLQGEGWDKIALNNLKLMDSVLKESQRLKPASTVTMGRYASREITLSDGTIIPKGSTVFIANVAMRDSNIYPDPDDFVPDRFTTRREKGDSSAYLVSASPEHLGFGLGRHACPGRFFAANELKIVLSHMLMKYDIKLPDNGAVAPSKSGIFLATNPDARICVRRRKEEIVI

SEQ ID NO: 1405 - protein, 539 aa, Myceliophthora thermophila
  misc_feature (168)..(514): Pfam Name: p450 Pfam Description: Cytochrome P450
  misc_feature (1)..(539): Bit score of 583.9 for HMM based on sequences of Figure 8
  misc_feature (1)..(539): Functional Homolog Of SEQ ID NO. 1386
MADHGPPPSSAAPSGPSGPLGGFGFPISGPAATLGALPASVPYHPYLLAAGLAVLFLFWLQPLSSSSTSKFPHLNPRKPLELTETRRKQEFVINSGAMLDAWFREHPNQPARVIGDAGEVIVLPPHLTNELRNDPRLSFAGWINFHAHIPGFEGFREGSRDSQIVQEVIMKDLTKYLNKITEPLSEETALAVNELYPADNDQEWHTISPRERLLRLVARVSSRVFLGEEICRNEAWLRVTREYTVDAFGAAEELRLWPAPLRALVHWFLPSCRRARADVAEARHIIGAVLDKRRLQKQRGEKVEYDDAIDWFEREARGREYDPTVAQLTLSMAAIHTTTELVTQVMSDIAQDPDILDELRHEMVQVLRDGGWKKTSLYNMKLLDSVLKESLRLKPTGIISMRRLASDNIRFSDGTSIPKGSMVAVTARNHWDAGVYEKPEAWDGRRFLRMRETAGREHVAQMVSTAPDYLSFGHGQHACPGRFFAANEAKVILIHLLLKYDWRLSPDAPRPRIRHYGWTLRADPTTTMQYRRRRPEIDL

SEQ ID NO: 1406 - protein, 525 aa, Paracoccidioides brasiliensis
  misc_feature (1)..(525): Public GI ID no. 225679929
  misc_feature (1)..(525): Paracoccidioides brasiliensis Pb03
  misc_feature (96)..(494): Pfam Name: p450 Pfam Description: Cytochrome P450
  misc_feature (1)..(525): Bit score of 754.8 for HMM based on sequences of Figure 8
  misc_feature (1)..(525): Functional Homolog Of SEQ ID NO. 1386
MATREVMSVYLAELMSTPNLPSVTFIVTAVTLLSIYMLQRPKTNVPLLTLKKRFEFSNKRVKQNLIRDAIGVVKQCFATTGNKPFRMITESGEEITILPATFANEIRNDNRLSFEEQIHRNFFGHLPGFEVFRVNSENMKLMKSVVQRQLTTNLGKLTKPLSDEATLSFREILTDNKEWNKITIKEKFLQIVARVSSKVFLGDELCHDPKWLDITIAYTLVAFGAAEALRLWPAWTRDFVHWFLPECRQSRAEVKKARKVIQPFLKKRAADKAALAAQGKKPPVIHDAIEWFEQASGEVEDLYDPVVVQLGLGLAAIHTTTDLIIQVILGLVEHPEIIEPLRKEIFDALSEGGWKKTSLYKMKLLDSVIKESQRMKPISSITMSRVTLDNITLSDGTTIPKNVMTAVSSNRMWDPTVYADPDQWDGYRFYNMRHQPGQENTAQFVTTSPDFLAFGHGQHSCPGRFFAGNEIKVILCHLLLKYDLKLVEGAYTKPFSVSHSLYANPFAPVMIRRRDEGIDIDSLGS

SEQ ID NO: 1407 - protein, 529 aa, Aspergillus nidulans
  misc_feature (1)..(529): Public GI ID no. 67902304
  misc_feature (1)..(529): Aspergillus nidulans FGSC A4
  misc_feature (240)..(504): Pfam Name: p450 Pfam Description: Cytochrome P450
  misc_feature (1)..(529): Bit score of 442.3 for HMM based on sequences of Figure 8
  misc_feature (1)..(529): Functional Homolog Of SEQ ID NO. 1386
MLQSLLQNNFVAVLGLLIVFGTATSLTWTAFTILSPYLRVKGAKIFNDRTGSEILWTNARKRFQRGARELFKAAFAQHPNAFYIMTDTDVELILDSKYAPEVRNDRRFDIGKYNEDMFHGTIAGFEMFENDHVLERVFVETVRNKLTRAIGKFVKPISLEAADGLREYWTDDTGIPAPTRNHSCVLRTIAKQSSRVFQGPPLCYNPDWLRITVNHTVTFFEAAESLKVWPHPLRPLAAKFLPLCKKLRAEAQEARRIITPILEERLKRAQARMAEKNNLPEKKTEVKEEGDSDGNMIEWAEETANGAIYDAALLQMKVSLASIHTTSDLVSQTLFNLCSRPELVNDLRKEVIEVIGQQGWVKPALYQLKLMDSVLKETQRLKPISIGTMVRTTTSPVTFSDGLQVPANTRTLVSCHNMWTESVHENPEVFDGYRFLKLRQLPGQENWTQLVSTSNNHLGFGHGMHACPGRFFAATTAKVLIAHVVLKYDLKLLDGQKPVIIEHGAAQYANVWCPIGVRRRREEIDLSDL

SEQ ID NO: 1408 - protein, 525 aa, Fusarium oxysporum
  misc_feature (1)..(525): Public GI ID no. 342877778
  misc_feature (1)..(525): Fusarium oxysporum Fo5176
  misc_feature (164)..(503): Pfam Name: p450 Pfam Description: Cytochrome P450
  misc_feature (1)..(525): Bit score of 1068.1 for HMM based on sequences of Figure 8
  misc_feature (1)..(525): Functional Homolog Of SEQ ID NO. 1386
MTNNSSYYYEFYKSHSHAVMDFMSENTLTSSCLILATSAVLLCIQWFKPQPLIMVNGRKFGELSNVRAKRDFTVGARQLIEKGLHMSPDKPFRIMGDVGELHILPPKYAYEVRNHDKLSFTMAAFKWFYAHLPGFEGFREGTNESHIMKLVARHQLTHQLTLVTGAVSEECALVLEDVYTDDSEWHDITAKDANMKLMARITSRVFLGKEMCRNPQWLRITSTYAVIAFRAVEELRFWPAWLRPVVQWFMPHCTESRALVQEARDLINPLLERRRAEKAEAERTGEKVTYNDAVEWLDDLAREKGVGYGPACAQLSLSVAALHSTTDFFTQVMFDIAQNPELVGPLREEIISVLGKQGWSKNSLYNLKLMDSVLKESQRLKPISIASMRRFTIHDVKLSDGVILPKNKLTLVSAHQHWDPEHYKDPLKFDGYRFYNMRREPGKESKAQLVSATPDHMGFGYGLHACPGRFFASEEIKIALSHILLKYDFKPVEGSSMEPRKYGLNMNSNPTAKLSVRRREEEITI

SEQ ID NO: 1409 - protein, 525 aa, Paracoccidioides
  misc_feature (1)..(525): Public GI ID no. 295667161
  misc_feature (1)..(525): Paracoccidioides sp. 'lutzii' Pb01
  misc_feature (84)..(493): Pfam Name: p450 Pfam Description: Cytochrome P450
  misc_feature (1)..(525): Bit score of 746.7 for HMM based on sequences of Figure 8
  misc_feature (1)..(525): Functional Homolog Of SEQ ID NO. 1386
MATREVMSGYLAELVSTPNLPSVSFIVTAVTLLSIYMLQRPKTNVPLLTLKKRFEFSNKRVKQNLIRDAIGVVKQCFATTGNKPFRIVSESGAEITILPANLANEIRNDKRLSFAKNVHRNFFGHLPGFEVFTANGSNMRLLKQIIQRQLTTYLGNVTKPLSDETTLSFREILTDNKEWNKITVKEKVLQIVGRVSSKVFLGDELCHDPRWIDITITYTLVAFGAAEALRLWPAWTRSFVHWFLPKCRQSRAEIKKAREVIEPILKKRAAHKAALAAQGKKPPVINDAIEWLEQASGDGEEKPDPVIVQLGLSLGAIHSTADLVTQVMLDLVEHPEIIEPLRKEIFDTLSEGGWKKTSLYKMKLLDSVIKESQRLKPISTITMARVALENITLSDGTIIPKDVMSAVSSNRMWDPTVYANPDQWDGYRFYNMRHQPGQENVAQFVTTSPDYLVFGHGEHACPGRFFAANEAKVIFCHLLLKYDLKSVEGAYIKPLPVSHALYANPFAPVMIRRRDEGIDIDSLGS

SEQ ID NO: 1410 - protein, 512 aa, Fusarium cerealis
  misc_feature (1)..(512): Public GI ID no. 270160618
  misc_feature (167)..(477): Pfam Name: p450 Pfam Description: Cytochrome P450
  misc_feature (1)..(512): Bit score of 486.8 for HMM based on sequences of Figure 8
  misc_feature (1)..(512): Functional Homolog Of SEQ ID NO. 1386
MAIISTLSDVRLDMLAYFVAFLVVVSVVRKKLAPKPSAYLLNPRRWYEFTDARAVSEVLHTTRQTLEEWFHKHPTTPVRLTTDFGEMTFLPPTLADEIKSDKRLSFIKAANDSAFHTEIPGFEPFREGGRNEAGLIKEVIHGQLKKTLNKMTFPLAQETQLAVEHYLGANKEWHKIRLRDALLPLVTRISTRIFLGEDLCQNDKWISITSEYAANSLEVANRLRVWPKYMRYVVSYFSPGCGILRNQVKNARELITPIVERRRSEEKGKEYNDSLGWFEKTAKQAYNPAATQLFLSAVSVHTTTDLICQCLEDIAAHPEIIKPLQEEIRRVIAEEGWNTKAMYKMFLLDSVFKETQRLKPIQVASMVREAQSDITLSDGTFIPKGHQIAVSCHNMRDGRIYENPEKWDGYRFFRERQQSAREDKVQLSSTSVEHMGFGYGEHACPGRFFAAKQVKIVMMYLLLNYEWKIPEGPEPQLMAWCTTWVTDPDYEVLTRRKDKDDPCLRLELVQDE

SEQ ID NO: 1411 - protein, 519 aa, Aspergillus niger
  misc_feature (1)..(519): Public GI ID no. 134076920
  misc_feature (373)..(480): Pfam Name: p450 Pfam Description: Cytochrome P450
  misc_feature (1)..(519): Bit score of 427.7 for HMM based on sequences of Figure 8
  misc_feature (1)..(519): Functional Homolog Of SEQ ID NO. 1386
MFAANIISYLAKLVPPRWIWAPILAAVFFWLLSAPSLKTSLPVINQRRRFEIGSLGSLKRFFKDAHGLVRAGLSQGSAFYLYSEFGPKIVLASKYADDFRSHHALSLLDAVAEEYHAHIRGFDPFNRDPAIIIDMTGRALGELFTDDPDWHDLELKPNMLDLISRLTSRVFLGEKLYRNPDWHRVTAGYAVHTFMSALFLRMFPRCTRPFVANLLPFCRKMRKELQEAKDIITPVVEERRTAKQDAIRQGKEPERYVDAMQWMEECAKGRPYDPTLAQISLTLATIHTTSDLLTQTLFYLAERDEIIVALRNEVITVLQGDGWSKSTFNNLKLMDSILKESQRLKPHNMGKPPLLSLPMKLKNPFLMQPQIVAMRRFAQEDVTLSDGTVLPKGSISVLTTEAMRDPTIYPDPETFDAYRFLKLRETPGYETMAQAVSTTPQHLAFGLGKHACPGRFFAIALLKIILCHILLEYDFKIADGWSPTVRKYGFIWQADPVAKVSVRRRKEEFTILWDYQSTI

SEQ ID NO: 1412 - protein, 516 aa, Muscodor strobelii
  misc_feature (202)..(501): Pfam Name: p450 Pfam Description: Cytochrome P450
  misc_feature (1)..(516): Bit score of 583.3 for HMM based on sequences of Figure 8
  misc_feature (1)..(516): Functional Homolog Of SEQ ID NO. 1386
MLSSLQSQAPISGPLLTWMQQPSAMGFSIFAAILIATVVRSTWNPTRDDYDTVNPRKWFEFTDAEATKKFLIHARDYLHVSHKTTPNRPFRVIADVGDTLVLPNSYADEVRNIKDLDNDAVSRKDFHTHLSSFASFRIGVDGSGLSKSVVQKQLTQSLGLVTDPLSTECDLALREVLSDNQDWHLISPLRDAVLMIVARLSSKVFLGEELCHNQEWLKITAEHTTTAFQAVEELRLWPPILRPVVHWVLPSCRRARAQIARSREIINPVLEKRREARRWGGERPHDGIEWFENNAKGRNYDPALAQLNLSIAAMHTTTDLLMQTILDIAKHPEIVEPLRQEVRGALHEHGWEKTALYKMKLLDSAIKETQRIKPIQMISMRRLPLRNITLSDGTLLRKDREVVVAADRMWDESVYTEPEIWNPYRFYKLRKAQGSSFEHTAQLVSTSADHLGFGHGMHACPGRFFAANEVKVALAQLLLKYDWKLPEGADASFLQHGWSMVANPFVGILLRRRDEN

SEQ ID NO: 1413 - protein, 520 aa, Verticillium albo-atrum
  misc_feature (1)..(520): Public GI ID no. 302423784
  misc_feature (1)..(520): Verticillium albo-atrum VaMs.102
  misc_feature (251)..(494): Pfam Name: p450 Pfam Description: Cytochrome P450
  misc_feature (1)..(520): Bit score of 484.2 for HMM based on sequences of Figure 8
  misc_feature (1)..(520): Functional Homolog Of SEQ ID NO. 1386
MESSSSAPTQPPLLGSWAESTPMAHLDAQQLLYLGLALFVALASCVRALGSKEESIPCLNPSKRPLIFGKDPAASQSFVKNARGILAEGRKRFPGQPFRITSDSGETTILPPSLINDIRNEPGLSFIEAISETFHTHLPGFEPFATGNRADSLIQVTEPLSEETSFATELAFGKSAEWKEFVLKTEILDLVARLSSRVFLGPDVARNEDWLSITKSYTIHGFLAAEQLRNYSPWWRRLANQFLPECRLVRRQLVEARAIIGPVVQKRRDDRQQAVDRGLPPPVFNDALDWFEAESHGSAYDAAICQLSLSTAAIHTTTDLLTEVMFNIAKHPEIVTDLRQEIVSVLTAEGWKKTALYNLKLLDSVVKESQRMRPVGLVSMMRTATRDVPLSNGMVLRKGQRTAVDMAQMRDPNVYDDPDTFDAYRFVRMRDTPGQENQAHFVSTGPASLGFGHGQHACPGRFFAANEVKVALCHLVMKYEWILAPGCEPKAAEFGFSLAVDMNAKVLMRRREPELDIDAL

SEQ ID NO: 1414 - protein, 520 aa, Fusarium armeniacum
  misc_feature (1)..(520): Public GI ID no. 270160651
  misc_feature (147)..(480): Pfam Name: p450 Pfam Description: Cytochrome P450
  misc_feature (1)..(520): Bit score of 496.2 for HMM based on sequences of Figure 8
  misc_feature (1)..(520): Functional Homolog Of SEQ ID NO. 1386
MSFINSMEDLRFDILIYFLCFVVLVRSVQWFLRRKPNAPLLNPRRFYEFSDSRAVSEILYSTRQVLEDWFSKHPTKPMRITADLGQITILPPSMADEIKNDPRLSFIKASTESAFHITIPGFEPFREGAKNEAALIKNVLHKHLNKTLNHITLPLAEETCLAVQDYFGSDQSWHRVPLRDTLVPLVTRISTRIFLGQDLCRNQEWLQIAASYSSTSAEVANHLRRWPRPFRYLVSLLSPECQNLAKQVRNARALINSILERRRVEEGQEKGTSYNDSLEWFERYAREAYDPAATQLFLSVVSIHTTTDLLCQALEDISSHPEIIKPLQDEIRQVLKEEGWNTKALYKMKLLDSVLKESQRLKPVQHATMLRLALEDITLEDGTFIPKGHQISVSCHAMRDNEIYENASSWDGYRFYRQRELSANEHKAQLSSTSPEHMGFGYGLHVCPGRFFAANEVKVIMIYLLLQYDWRTPPGCQPKPLSWCTTWATDPTFELEVRRKGSDDIPVELSHSTFNEESES

SEQ ID NO: 1415 - protein, 513 aa, Sphaceloma manihoticola
  misc_feature (1)..(513): Public GI ID no. 197724589
  misc_feature (73)..(504): Pfam Name: p450 Pfam Description: Cytochrome P450
  misc_feature (1)..(513): Bit score of 664.3 for HMM based on sequences of Figure 8
  misc_feature (1)..(513): Functional Homolog Of SEQ ID NO. 1386
MAFTAQSYFDIGEHLRVSVILLLTTVVLLLVFSLKARKKSLLPLVNGNRWTDPLGIEAKKKFMTSARSIIAEQLEKAPGKPFRVVSDVGELVVLPPEFAPEIRNHKDFSFTMAAYKWFYAHLPGMEGFREGTTESQIMKLVARHQLTHQLTVVTAPVAEESARALRDVFGCDEGWRELGTRQACLQVIARVSSRIFLGQELCRNPDWLRVTSTYSVLAFRAVVVLRFWPAPLRNLVHWFLPACKAARDLVQEARDLVNPLLQERNEERRAQAKGESVLYRNDAIDWLEELATDKNLNYDPAASQLSLSTAALHSSTDFFAQLLLDLAERPGLAEELRQEAAKVVNTEGWSKGSLFDLKLMDSVMKESQRLKPISLASMRRYTTADVKMSSGDVIPKGSLTVVSAYRHWDEKTYERPDEFDGHRFLRMRSQEGKEHQAHLVSATQDHFGFGYGLHACPGRFFAAEEVKIVLAQMLLQYEIRLVAGSDSRPVHAGLNMYANPASKISVRYRGSSF

SEQ ID NO: 1416 - protein, 512 aa, Fusarium boothii
  misc_feature (1)..(512): Public GI ID no. 269978406
  misc_feature (167)..(478): Pfam Name: p450 Pfam Description: Cytochrome P450
  misc_feature (1)..(512): Bit score of 489.1 for HMM based on sequences of Figure 8
  misc_feature (1)..(512): Functional Homolog Of SEQ ID NO. 1386
MALITSLQDVRLDMLAYFVAFLVVVSVVRKKLAPQPSAYLLNPRRWYEFTDARAVSEVLHTTRQTLEEWFHKHPTTPVRLTTDFGEMTFLPPTLADEIKSDKRLSFIKAANDSAFHTEIPGFEPFREGGRNEAGLIKEVIHGQLKKTLNKMTFPLAQETQLAVEHYLGANKEWHKIRLRDALLPLVTRISTRIFLGEDLCQNDKWISITSEYAANSLEVANRLRVWPKYMRYVVSYFSPGCGILRNQVKNARELITPIVERRRSEEKGKEYNDSLGWFEKTAKQAYNPAATQLFLSAVSVHTTTDLICQCLEDIAAHPEIIKPLQEEIRRVIAEEGWNTKAMYKMFLLDSVFKETQRLKPIQIASMVREAQSDITLSDGTFIPKGHQIAVSCHNMRDGRIYENPEKWDGYRFFRERQQSAREDKVQLSSTSVEHMGFGYGEHACPGRFFAAKQVKIVMMYLLLNYEWKIPEGPEPQLMAWCTTWVTDPDYEVLMRRKDKDDPCLRLELVQDD

SEQ ID NO: 1417 - protein, 528 aa, Aspergillus terreus
  misc_feature (1)..(528): Public GI ID no. 115385431
  misc_feature (1)..(528): Aspergillus terreus NIH2624
  misc_feature (149)..(497): Pfam Name: p450 Pfam Description: Cytochrome P450
  misc_feature (1)..(528): Bit score of 452.3 for HMM based on sequences of Figure 8
  misc_feature (1)..(528): Functional Homolog Of SEQ ID NO. 1386
MTVDALTQPHHLLSLAWNDTQQHGSWFAPLVTTSAGLLCLLLYLCSSGRRSELPVFNPKTWWELTTMRAKRDFDANAPSWIESWFSQNDKPIRFIVDSGYCTILPSSMADEFRKMKELCMYKFLGTDFHSHLPGFDGFKEVTRDAHLITKVVMNQFQTQAPKYVKPLANEASGIITDIFGDSNEWHTVPVYNQCLDLVTRTVTFIMVGSKLAHNEEWLDIAKHHAVTMAIQARQLRLWPVILRPLVHWLEPQGAKLRAQVRRARQLLDPIIQERRAERDSCLAKGIEPPRYVDSIQWFEDTAKGKWYDAAGAQLAMDFAGIYGTSDLLIGGLVDIVRHPHLLEPLRDEIRTVIGQGGWTPASLYKLKLLDSCLKESQRVKPVECATMRSYALQDVTFSNGTFIPKGELVAVAADRMSNPEVWPEPAKYDPYRYMRLREDPAKAFSAQLENTNGDHIGFGWHPRACPGRFFASKEIKMMLAYLLIRYDWKVVPNEPLQYYRHSFSVRIHPTTKLMMRRRDEDIRLPGSL

SEQ ID NO: 1418 - protein, 458 aa, Trichophyton verrucosum
  misc_feature (1)..(458): Public GI ID no. 302657172
  misc_feature (1)..(458): Trichophyton verrucosum HKI 0517
  misc_feature (289)..(435): Pfam Name: p450 Pfam Description: Cytochrome P450
  misc_feature (1)..(458): Bit score of 415.1 for HMM based on sequences of Figure 8
  misc_feature (1)..(458): Functional Homolog Of SEQ ID NO. 1386
MLEALIQSGSAYRVDLALSFVVLLVASYIARLVSHRQRYAKFPLHIDKSNPKQMLLSGFAKYKNAFHINTAIGKDIILSADYANELKSDPHLDFAKAILPTLLTHLSTFHHIEEAGKNQVLTETIRSKLSRLPEWHEIPIKETIVKIVARMSSRVFLGEELCRNEEWLRITAEYTINLFIAVNELMTWPTYVRPIVQWFLPPCQRLRQQVADARRLIQPVIDARHAENDELRRQGKPLKQHEDAIAWLDEKSGGRSFDAAIAQLSLSFVSIHTTTDLRTQALYDICANPRELDTTALYQMKLLDSVIKESQRIKPAGLLSMKRYVKESITLSDGLVVPKGTSISISSHVHWDESVYPEPNKFDGYRFLKMKGDREKDRMANLVATSPEHLGFGHGVHACPGRFFAADEIKILLCHILLKYDFRLTEKSNTTPYMMPGGAYMANSTQIEIRRRKEEIAL

SEQ ID NO: 1419 - protein, 507 aa, Colletotrichum higginsianum
  misc_feature (1)..(507): Public GI ID no. 380480560
  misc_feature (297)..(486): Pfam Name: p450 Pfam Description: Cytochrome P450
  misc_feature (1)..(507): Bit score of 410.2 for HMM based on sequences of Figure 8
  misc_feature (1)..(507): Functional Homolog Of SEQ ID NO. 1386
MALDIFESLSRLSGSSSLAILISTTVALLIILFFHWLKNDTIPIINKYKGDIFSKKAHAEYLTNSEKLISDGVARYNGPFRVITTLGSRVILPAKLANWVKNCKDLDHVQLVADEYFAGYPGFDGNGAVVNPDRMLIEVTKAKLNQSSQCELFHRYLSELLEQEWADKNDNWRPVPWGQDVARYVGRMSSAVFVGPDLARDPEWQALILSYTVNLFNGVRALRTWPAFTRSFIHWVLPECRTCRKQLVLARGLLQPIMDKRRRTAFELKAAGQDSPSYNDTVAWVEEVAAGRPYDPAATQLGFAIAAMHTTTELLKQTLVDICFHPELIQPLRDEAEAAVGQHGWTTAGLFQMQLMDSVIKETQRMKPGSLVNLERKATRDVAMPDGTVLPRGTNVAVDTAGMWDPEIFKDPRKYDGYRFYNLRKDGGAASNTAQLVSVSNDFIAFGLGRSVCPGRFMVANEIKAALATILLRYDVRLADGQRPRVVHYGFEMLSDPTTVLEVRRRA

SEQ ID NO: 1420 - protein, 518 aa, Aspergillus fumigatus
  misc_feature (1)..(518): Public GI ID no. 146324548
  misc_feature (1)..(518): Aspergillus fumigatus Af293
  misc_feature (152)..(496): Pfam Name: p450 Pfam Description: Cytochrome P450
  misc_feature (1)..(518): Bit score of 485.1 for HMM based on sequences of Figure 8
  misc_feature (1)..(518): Functional Homolog Of SEQ ID NO. 1386
MVSSFSSKRLGDTMDSLALGSNWAGGVAIVLFLAPLALHLVSSYLFPSTSTVINSGRAWDIFRTTAKKRFRSDAARLLQNGFEKSPDAFRILTDNGPLLVLSPRYAREVRSDDRLSLDHFIASEFHPDIPGFEPFKLILDPRNPLNTILKTSLTQALEDLSVEVADALSTALTDDSEWHEISPCQTALKLVAQMASKAFIGPEKCRDPKWHNVIITYTHNVYRAAQALHFWPKFLRPIVARFLPACQTLQAQIAEAREILEPLVAQRRADRACRAAQGKPVPSRADVIDWLEDSHGDQPYDPVAAQLLLSFAAIHGTSNLLAQALMDLCTAPDLIRDIRAEITSVLGDAGLTRAALYRLKLMDSALKESQRLAPNRLLSMGRIAQSDMHLSDGLRIPRGTTLMVSAHAMWEPQIYPDPRRYDGYRFYKLRQVPGQEGQHQLVSATEKHMGFGYGKHACPGRFFAAAEIKVALCHILLKYDLEHRGGGPPPRVWSQGIHLFPDPTARIRVRRRKEEISL

SEQ ID NO: 1421 - protein, 497 aa, Zymoseptoria tritici
  misc_feature (1)..(497): Public GI ID no. 339469066
  misc_feature (1)..(497): Zymoseptoria tritici IPO323
  misc_feature (291)..(476): Pfam Name: p450 Pfam Description: Cytochrome P450
  misc_feature (1)..(497): Bit score of 475.8 for HMM based on sequences of Figure 8
  misc_feature (1)..(497): Functional Homolog Of SEQ ID NO. 1386
MIILALAAVAVHWSDRSSNPLLNAKGFFELSDRRIKIAFLGNARPMLSDWFGKHQNSPVSIYSDTGVLMVLPGSMANEIRNDKRFHLRQQVERVSKALFSIYHSASLTLKKMMHGRLPGFEVFRDDYNNHIVKTVINRDLTKQLGKRTSPLHLSTKYQWPYRSCLDPTQLVARTSSRVFLGAELCHNPEWLKVSKEYAVLAFLAAQDLRLWSPWLRPIASLFLSKCRLSRAAIHKARATIEPVLAERSKLVAKNTGGKATVFDDAIAWIECAAGTASYDPQIVQLSLSAVAVHTTTDLLSQALADIAAHPEIIAPLREEMISIMNQDGVLQTASLGRMELLDSCIKESQRMKPLSIASMGRIATERVTLSNGTVIPKGQSILVDSSRMWDAKVHPSSPKTWDGYRFLRMREDPMKRDMAPLVSTSPDHIAFGYGVHACPGRFFAANEVKIALIYILLKYELRFEEGQMPRAFDHGFTCVSDPSLKLSVRRRTEATVL

SEQ ID NO: 1422 - protein, 526 aa, Ajellomyces capsulatus
  misc_feature (1)..(526): Public GI ID no. 154273751
  misc_feature (1)..(526): Ajellomyces capsulatus NAm1
  misc_feature (126)..(506): Pfam Name: p450 Pfam Description: Cytochrome P450
  misc_feature (1)..(526): Bit score of 950.4 for HMM based on sequences of Figure 8
  misc_feature (1)..(526): Functional Homolog Of SEQ ID NO. 1386
MAELISTSNLPSVTFVVTALTLAVFYTLQRRRSMVPLINPKRWFEFSDYRIKQEFVHNAIPLVKQGFAATGNKPFRILADSGEVTVLPPDAANEIKSNDHMSLELNVSKNNCKSDTVTIAKHFFGHLPGFEVFNATGLDMKVSKSIVQRQLTTHLNKVTKPLSDEASLSLQEILTDNKEWHEITLKNELLQIIARISSKVFTGDELCHDKRWLDITVNYTIMAFAAAESLRMWPPYLRSIVHWFLPKCRASRAEVVRARTVIEPILKRRAEQKAAFAAQGKKAPEINDAIEWFTSATTIEGFTLDPVIAQLGLSLAAIHTTGDLSTQVILDIASHPEIIEPLRKEMIESLSEGGWKKNSLYKLKLLDSVIKESQRMKPIASINMNRITTANVTLSDGTFIPRNTSTAVSSHRMWDPSVHTNPDQWDGYRFYNKRQEPGQENLSQLVSTSPDHPAFGHGQHACPGRFFAANEIKVLLCHLLLKYDLKIVEGSMIKPFSYSFSMNANPFAPLMIRRREDVIDLDALDA

SEQ ID NO: 1423 - protein, 545 aa, Magnaporthe oryzae
  misc_feature (1)..(545): Public GI ID no. 145616804
  misc_feature (1)..(545): Magnaporthe oryzae 70-15
  misc_feature (182)..(515): Pfam Name: p450 Pfam Description: Cytochrome P450
  misc_feature (1)..(545): Bit score of 410.8 for HMM based on sequences of Figure 8
  misc_feature (1)..(545): Functional Homolog Of SEQ ID NO. 1386
MASSSKLDLAWLQKQPVGQGFLEMSQSTIAVTLAALVLVPVIASYIFAGRKGAAEIPLMNPPGPFELALSKAVQFPQQGLDLYNKARKLFPDQPVKFITNAGTLTILPSDRAQEVKGIRSLDFRKSFSYSAPLTAPGGAALSTFDHPNEIVQTVVSKYLTKRLRPLASEATFTINKNFGNSPEWTEVKMYDVGLDVVARLSSRVFLGSEICRNEEWLETTKRITMVFTSVLQTARVYPTWLRPLVYRFGKHGRDMMAVTKQVNDIVNPIVEKRKLEMAECEARGEPAPVYNDAIEWILSEHDPNDRIFKVADFQIALSVAAVHTTSDLLSHTMLTLAANPQHIEPLRKEMIEVLGTGGWKKTSLTSLRLLDSAVKEAQRIKPVQRVASNGLPENQTVSMQRLVTEDTTIEGGYRLRKGELVGVDTYPLRDPAKWPEPETFDPYRFYQARKQPGGEHKAQLVSVSPDHLTFGYGKYACPGRFFAANEVKLALCHLLLKYDWKLPEGGSDQPIMFGLDPIVNPGATIMFRRRKEELDLDSLLVDSEE

SEQ ID NO: 1424 - protein, 522 aa, Fusarium
  misc_feature (235)..(501): Pfam Name: p450 Pfam Description: Cytochrome P450
  misc_feature (1)..(522): Bit score of 565.6 for HMM based on sequences of Figure 8
  misc_feature (1)..(522): Functional Homolog Of SEQ ID NO. 1386
MLGDLFESVLTNNSVTLLITVAVAAIALHLSSPKSNLPLVNDKKPWEFRFTKARKRFLANAHNLIKAGLAKAPAFRIVTGNGKRVVLDAKYANELRSHDDLSFGLHIADNFHAHIRGFQPFKQGSNDDEIYQNAVRMKLTQSLGNLTQPLVDETLVALQTYWTNDTSRSMPLTSTGRLLSHDWHAIPLKSNIQKVVAQLSSRIFLGDQICRNPNWLRIAVDYTVDAFKAAEELRLWPKAFRAIVALFLPSCRKIRAELQEAQDIIRPVLDARRKDKQAALSAGKEPERYNDAMQWLEECAKGRSYEPAFGQLTFSVAAIHTTSDMLTQVLYDLCGRDALIQALREEVITVVQEEGWTKPTLYKLKLMDSVLKESQRLKPISVVSMQRVATADLRLSDGTFIPKGTSLAVSSDRMWDSEIYPNPLEFDGYRFLKLRELPGHETSAQVVSPSPEHMGFGFGRHACSGRFFAINEVKIALCHILLKYEFKLADGSVPRATKFGFSFTSDPTTKLMIRRRQEETVL

SEQ ID NO: 1425 - protein, 542 aa, Fusarium
  misc_feature (1)..(542): Public GI ID no. 328671370
  misc_feature (1)..(542): Fusarium sp. YM-2010
  misc_feature (161)..(502): Pfam Name: p450 Pfam Description: Cytochrome P450
  misc_feature (1)..(542): Bit score of 502.4 for HMM based on sequences of Figure 8
  misc_feature (1)..(542): Functional Homolog Of SEQ ID NO. 1386
MSKVDKTGYAQWVYLLPERSSMMSFIDSMEDFRFDMLIYFLCFIILGRAVQWFLRPKPNAPLLNPRRFFEFSDSRAVSEILYSTRQVLEDWFSKYPTKPMRIIADLGQITILPPSMADEIKNDPRLSFIKASTESAFHITIPGFEPFREGAKNEAALIKNVLHKHLNKTLNHITTPLAEETCLAVQEYFGSDQGWHRVPLRDTLVPLVTRISTRIFLGQDLCRNQEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLLCQALEDISSHPEIINPLQHEIRQVLKEEGWNTKALYKMKLLDSVLKESQRLKPVQHATMLRLALEDITLEDGTFIPKGHQISVSCHAMRDNEIYENASSWDGYRYYRQREQSANEHKAQLSSTSPEHMGFGYGIHVCPGRFFAANEVKVIMIYLLLQYEWRTPPGSQPKPLSWCTTWATDPTFELEVRRKGSDDIPVELSHNTFSRESES

SEQ ID NO: 1426 - protein, 500 aa, Aspergillus niger
  misc_feature (1)..(500): Public GI ID no. 350629557
  misc_feature (1)..(500): Aspergillus niger ATCC 1015
  misc_feature (173)..(468): Pfam Name: p450 Pfam Description: Cytochrome P450
  misc_feature (1)..(500): Bit score of 443.2 for HMM based on sequences of Figure 8
  misc_feature (1)..(500): Functional Homolog Of SEQ ID NO. 1386
MFAANIISYLAKLVPPRWIWAPILAAVFFWLLSAPSLKTSLPVINQRRRFEIGSLGSLKRFFKDAHGLVRAGLSQGSAFYLYSEFGPKIVLASKYADDFRSHHALSLLDAVAEEYHAHIRGFDPFNRDPAIIIDMVRMKLTPHLGDLARPLSEETGRALGELFTDDPDWHDLELKPNMLDLISRLTSRVFLGEKLYRNPDWHRVTAGYVVHTFMSALFLRMFPRCTRPFVANLLPFCRKMRKELQEAKDIITPVVEERRTAKQDAIRQGKEPERYVDAMQWMEECAKGRPYDPTLAQISLTLATIHTTSDLLTQTLFYLAERDEIIVALRNEVITVLQGDGWSKSTFNNLKLMDSILKESQRLKPHNMDVILSDGTVLPKGSISVLTTEAMRDPTIYPDPEIFDAYRFLKLRETPGYETMVQAVSTTPQHLAFGLGKHACPGRFFAIALLKIILCHILLEYDFKIADGWSPTVRKYGFIWQADPVAKVSVRRRKEEFTIL

SEQ ID NO: 1427 - protein, 524 aa, Ajellomyces dermatitidis
  misc_feature (1)..(524): Public GI ID no. 261204397
  misc_feature (1)..(524): Ajellomyces dermatitidis SLH14081
  misc_feature (99)..(497): Pfam Name: p450 Pfam Description: Cytochrome P450
  misc_feature (1)..(524): Bit score of 872.5 for HMM based on sequences of Figure 8
  misc_feature (1)..(524): Functional Homolog Of SEQ ID NO. 1386
MAALEPKSGYLAELVSTSNLPSVTFVVTALTLILFYTLQRRKPNVPLINPKRWFEVSDQRIKQEFVHNAIPMIEKGFAVTGNKPFRVQADSGEVTVLPPNVANEIKNDARLSFELNTSRAFFGHLPGFEVFNTDGCNMRVAKSIVQRQLTTYLAKVTKPLSDEATLSLREILTDNKEWHQITLKNELLQIIARLSSKVFLGDELCHDERWLDITINYTLHAFAAADSLRMWPSYLRDIVHWFLPRCRASRAEVARARTVIGPILKKRAEHKAALAAQGKEPPGLNDAIEWFENASRAEGTYVDPVIGQLGLGLAAIHTTSDLSTQVILDIASHPEIIEPLRKEIIEALREGGWKKTSLYKMKLLDSVIKESQRMKPITSISMGRVATTDITLSDGTTIPKDTHTVVSSHSMWDPRVHTNADQWDGYRFYNMRQVPGQENSSQFVSTSPDHLAFGHGQHACPGRFFAANEVKVLLCHLLLKYDLKVVEGSMIKPFRYSFSISANPIAPLMIRRREDVIDLDSLEA

SEQ ID NO: 1428 - protein, 516 aa, Penicillium chrysogenum
  misc_feature (1)..(516): Public GI ID no. 255939330
  misc_feature (1)..(516): Penicillium chrysogenum Wisconsin 54-1255
  misc_feature (116)..(480): Pfam Name: p450 Pfam Description: Cytochrome P450
  misc_feature (1)..(516): Bit score of 571.6 for HMM based on sequences of Figure 8
  misc_feature (1)..(516): Functional Homolog Of SEQ ID NO. 1386
MLGYALNGSLPGDVVVAVGVILLAGYVLQFAFAVGSKLPLINQNSILDFGSMKSRRSYVTGAADLIKSGFAKSAKGFRLVTDNGCQVVLPPRYLNEIRNHPDMSRDKASAKELHSHLPGFEPFREGSKDERIMHDVVLTKLTRKLGRVTEDLSKETAEVVRKYWTDEKEWHALSLRSTITPMLARMSSRVFLGELLCRDPSWLHITINYAVHVIRATDELRQWPKMLRPFVNRVLPSCRMIRSDMKQALGLITPILNKRRADREAAIKAGTPPTQYNDAIDWMEDVAKGRPYNPAISQLLLSMAAIHTSADMLTQILFDIAAQPDLVKALREEIITVTRENGWNKISLYKLVLMDSTIKESQRLKPVAITPMRRLTTADVELSDGVFIPKDTTILVSANSMWDEKNYENPEKFDGYRFLKMRDVPGQQTAAQLVAPSPIHLGWGFGQHACPGRFFAANEMKIALCQILLKYDIKLDEKRLPQVRRFGVSMTADSTANLLIRRRQEEVSPEELGCQV

SEQ ID NO: 1429 - protein, 524 aa, Gibberella intermedia
  misc_feature (1)..(524): Public GI ID no. 122894064
  misc_feature (142)..(500): Pfam Name: p450 Pfam Description: Cytochrome P450
  misc_feature (1)..(524): CYP68B1
  misc_feature (1)..(524): Bit score of 844.2 for HMM based on sequences of Figure 6
  misc_feature (1)..(524): in Figure 6
MSIFNMITSYAGSQLLPFYIAIFVFTLVPWAIRFSWLELRKGSVVPLANPPDSLFGTGKTRRSFVKLSREILAKARSLFPNEPFRLITDWGEVLILPPDFADEIRNDPRLSFSKAAMQDNHAGIPGFETVALVGREDQLIQKVARKQLTKHLSAVIEPLSRESTLAVSLNFGETTEWRAIRLKPAILDIIARISSRIYLGDQLCRNEAWLKITKTYTTNFYTASTNLRMFPRSIRPLAHWFLPECRKLRQERKDAIGIITPLIERRRELRRAAIAAGQPLPVFHDAIDWSEQEAEAAGTGASFDPVIFQLTLSLLAIHTTYDLLQQTMIDLGRHPEYIEPLRQEVVQLLREEGWKKTTLFKMKLLDSAIKESQRMKPGSIVTMRRYVTEDITLSSGLTLKKGTRLNVDNRRLDDPKIYDNPEVYNPYRFYDMRSEAGKDHGAQLVSTGSNHMGFGHGQHSCPGRFFAANEIKVALCHILVKYDWKLCPDTETKPDTRGMIAKSSPVTDILIKRRESVELDLEAI

SEQ ID NO: 1430 - protein, 487 aa, Fusarium oxysporum
  misc_feature (1)..(487): Public GI ID no. 342877779
  misc_feature (1)..(487): Fusarium oxysporum Fo5176
  misc_feature (157)..(463): Pfam Name: p450 Pfam Description: Cytochrome P450
  misc_feature (1)..(487): Bit score of 779.5 for HMM based on sequences of Figure 6
  misc_feature (1)..(487): Functional Homolog Of SEQ ID NO. 1429
  misc_feature (1)..(487): in Figure 6
MITSYAGSQPLSFYVAIFIFTLVPWAIRFSWPKLRKGSVVPLANPPESLFGTGKTRRSFVKLSREILAKARNLFPDEPFRLITDWGEVLILPPEFADEIRNDPRLSFSKAAMQDNHAGIPGFETVALVGREDQLIQKVARKQLTKHLSILDIIARISSRIYLGDQLCRNEAWLKITKTYTTNFYTASTNLRMFPRSIRPLAHWFLPECRKLRQERKDAVGIITPLIERRRELRRAAIAAGQPLPVFHDAIDWSEQEAEAAGSGSAFDPVIFQLTLSLLAIHTTYDLLQQTMIDLGRHPEYIEPLRQEVVQLLREEGWKKTTLFKMKLLDSAIKESQRMKPGSIVTMRRYVTEDITLSSGLTLQKGTRLNVDNRRLDDPKIYENPEVYNPYRFYDMRSEAGKDHGAQLVSTGSNHMGFGHGQHSCPGRFFAANEIKVALCHILVKYDWKLCPDTETKPDTRGMIAKSSPVTDILIKRRGSVELDLEAI

SEQ ID NO: 1431 - protein, 511 aa, Sphaceloma manihoticola
  misc_feature (1)..(511): Public GI ID no. 197724593
  misc_feature (224)..(482): Pfam Name: p450 Pfam Description: Cytochrome P450
  misc_feature (1)..(511): Bit score of 777.4 for HMM based on sequences of Figure 6
  misc_feature (1)..(511): Functional Homolog Of SEQ ID NO. 1429
  misc_feature (1)..(511): in Figure 6
MPQAIPAHKMMPIPGVGVYVFTVLWAATIYIASSLLRWSLDSLKHLPIVNNKEWYSLSGRKAKLRFLAESKSLLEEARKRYPQQPFRILSNWGVLLVLPSCFADEIRNDQRLSFSKAALQDSHGHIPGLETVKLVARDDQLIQTVARKHLTKHLAKVIQPLSEETEFALDQNFGHNPAILDIIARISSRIYLGDELCRNTAWLATTKVYTSAFFAAPVKLGLIPAPLRRLAHWLIPECKILREQVQEARRIIEPLVRRRQALRAKALAEGCPTPQFNDALGWAAEESAKNGKDYDPAITQLALSMLAIHTTYDLFQQCILDLAQNPHFIEPLRQEAIEVIQQYGWTKQGLYHMKLLDSALKETQRLKPGSMVTMRRYVLEDLQLSNGLILKKGTRINIDTQRMRDPDLHEDPLKYDAFRFYKMRQQPGGEHTAQLVSTSPDHLGFGHGEHSCPGRFFAANEIKVAMAHMLIKYEWKPAGHSSAGPDVKGLLMKSGAGAQIDIRRRETVEIA

SEQ ID NO: 1432 - protein, 528 aa, Phaeosphaeria
  misc_feature (1)..(528): Public GI ID no. 115334279
  misc_feature (1)..(528): Phaeosphaeria sp. L487
  misc_feature (60)..(498): Pfam Name: p450 Pfam Description: Cytochrome P450
  misc_feature (1)..(528): Bit score of 793.1 for HMM based on sequences of Figure 6
  misc_feature (1)..(528): Functional Homolog Of SEQ ID NO. 1429
  misc_feature (1)..(528): in Figure 6
MKHIDVMNFISKICSWSKDSPGFVLLISILVILGSVTFIPKCGRRSAFDALPIVNKPKFGPIFSIIARWRFIHQSKKILEEGQKCYSNRPFRIWTDWGEVLMLTPDYAHEIRNDPHLSFSGAVKIDGHADIPGFETVKLISHPDNLIQLVARKQLTRHLAAVIQPLSSVTEEALIKNLGKSQEWSEIYLKYAVLDIIARLSSRIYFGELLYQNEEWLSIVKNYATHFFTASSDLRKVPWAFRSLVHWFVPSCRALRLERYNARRVLEPVISQRRQLKEAAKTAGGTPLHFEDAIEWAEVEARVKGTKYDPVIFQLTLSLLAIHTTYDLLEMCMIDLAKRPDCIEDLRKEVITVLRKDGWTKNALYNMKLLDSAIKESQRLKPGSITSMRRYATSDVQLRDGVVLKKGNRLNVLTLHRSPDLFPSPDTYDPYRFYNIRGQPGKENWAQLVSTSVEHMGFGHGEHSCPGRFFAANEIKVALAHILVKYDWKLSDEAGGCTEVKGMVEKAGSKVKILVRQRQDVESVLDEA

SEQ ID NO: 1433 - protein, 527 aa, Glomerella graminicola
  misc_feature (1)..(527): Public GI ID no. 310799037
  misc_feature (1)..(527): Glomerella graminicola M1.001
  misc_feature (148)..(499): Pfam Name: p450 Pfam Description: Cytochrome P450
  misc_feature (1)..(527): Bit score of 794.2 for HMM based on sequences of Figure 6
  misc_feature (1)..(527): Functional Homolog Of SEQ ID NO. 1429
  misc_feature (1)..(527): in Figure 6
MSPSFLFSLLNMWDQLYIPPNVTAAALALLAVAALYLSFPSQRAHLKHLPLLNPSKGLPLFNIESKREFVFNSKELLAKGRKLFPKSPYRMITDLGEIVFLPVEQTDEIRNDPRLSFGSAFGEDFHGHLPGFQGAAVDSYDDAVLQTLVRKQLTKCIAQIIEPVSAEAAQALADKFGDSEDWREMEVKSVVLDTVARLSARVFLGEELCRNEDWLRATKEYTVNFFVAGTHLRMIPRPLRRVLHWFVPKCRELRASFDEARRIILPYIEKRRAARAAALAAGKKIPEFHDAIDWADQEAAARGVTYDPAILQLMLAVAAIHTTADLVTEIVLQLALHPEHFGPLRGEVLHILRSEGLKKSSLHNMKLLDSALKEAQRHKPPGVASLRRRVEKPLTLSNGLNLKIGDRIAIDTYRMGDPELHQDPETWDPYRFIRMAEQPGKANYAQLVVTSPDHLAFGHGDHACPGRFFAAYEIKIIMCHLLLKYEWEALPATDVSPMVLGFTNASNPTARVRVRRRKHVELDMDCL

SEQ ID NO: 1434 - protein, 514 aa, Nectria haematococca
  misc_feature (1)..(514): Public GI ID no. 302893705
  misc_feature (1)..(514): Nectria haematococca mpVI 77-13-4
  misc_feature (145)..(495): Pfam Name: p450 Pfam Description: Cytochrome P450
  misc_feature (1)..(514): Bit score of 800.1 for HMM based on sequences of Figure 6
  misc_feature (1)..(514): Functional Homolog Of SEQ ID NO. 1429
  misc_feature (1)..(514): in Figure 6
MLVKELLEAPWAFLNSTASASNIRLSYFVAPLIAITVACFFFTSKPNAPCLNPQGFFDIASGRAKKQFLFGLRSMLKTWFDANPHKPASVFSDIGPMTVLPPSMANEIRSDPRLSFVEFSAKFFHTSIPGFEAFNEGTRDSITLTVINKDLTKRLAQVTQPLAEETTLAMQEIFTDNKEWHLINVREKILHLVARISSRVFLGEELCRDEAWLKITREHAMNGFVAADLLRAWPEALRPVVSWFMPHCRTARSQIREAEKIIGPVISKRREAKDAALRAGREAPIHNDAIEWFEQASKGKPYNPALSQLFLSTVAIHTTTDLLCQTMIDIARHPEYFEPLREEVTRVLAQDGWKKTSLHSMQLLDSVVKESQRLKPLQLASMQRLAVKDVQLSDGTFIPKGTASCVSSHALWDPDVYEAPDTWDGHRFLRQRGIPGKENFSQLVSTSENHLGFGHGKHACPGRFFAANEIKIALAHLLLEYEWRLPEGEALDVEDFGITPIMNQTLKMEFRKRD

SEQ ID NO: 1435 - protein, 528 aa, Neurospora crassa
  misc_feature (1)..(528): Public GI ID no. 85110002
  misc_feature (1)..(528): Neurospora crassa OR74A
  misc_feature (170)..(507): Pfam Name: p450 Pfam Description: Cytochrome P450
  misc_feature (1)..(528): Bit score of 838.7 for HMM based on sequences of Figure 6
  misc_feature (1)..(528): Functional Homolog Of SEQ ID NO. 1429
  misc_feature (1)..(528): in Figure 6
MANPSATPSSIPSWMERLDIKSITDPSATPFSYLVTAFLLAVVVYSLQGPRFPKNIKHLNPKGPLEFSDTRPKKEFVYGSRQMLANWFKANPNKPCRVISDFGEAIVLPPRMANEIKNDDRLSFTRWTYKAFHGHLPGFEGFGEASRESHIVQEVIMRDLTKYLNKVTEPLAQETSMAMEANLPKAANGEWSTINLRSKILPIVARISSRVFLGEELCRNEEWLKVTQQYTIDGFGAAEDLRLWPAALRPIVHWFLPSCQRARADVRVARSILDPVLKKRRQEKAANGGKAEHDDAIEWFERTAKGKYYDPAVAQLVLSLVAIHTTSDLTCQVMTNLMQNPEFIAPLREEMIQVLSEGGWKKTSLYNMKLLDSVIKESQRVKPTGVASMRRYAEKDVTLSDGTFIPKGGFVAVSAHDMWNSEVYEQAEKWDGRRFLRMRETPGAGKENVAQLVSTAPEHLGFGHGQHACPGRFFAANEIKIALVHLLLNYEWRLPEGSDPKIRTFGFSMGVDPSLKVEYKGRQPEIEL

SEQ ID NO: 1436 - protein, 548 aa, Aspergillus oryzae
  misc_feature (1)..(548): Public GI ID no. 169783174
  misc_feature (1)..(548): Aspergillus oryzae 3.042
  misc_feature (105)..(520): Pfam Name: p450 Pfam Description: Cytochrome P450
  misc_feature (1)..(548): Bit score of 803.3 for HMM based on sequences of Figure 6
  misc_feature (1)..(548): Functional Homolog Of SEQ ID NO. 1429
  misc_feature (1)..(548): in Figure 6
MDHFNLAGPESNTSITSLEWLGIKNSFTGSHWAHITGLSELHPTGFLCLIATLIIGIVHLTRGPKPTVLPVVNPPGTFELTANRVKKEWLVDARQIIRRGFEKFPGKPFNMIAADVGLTTVLPPEYASEIRNNPSLSFVAFMAHLFFSELPGFEPTREGMFDNDIGITVVHKYLTVNLARITEPLSREATAALKDIFTDNSEWHDANLKAINLALVARLSSRIFLGEELCRNEEWLKITVNYTVDVMKAAERLRRVPGPLRRIVHWFLPEAQKCRDEVKRAGKVIRPVLEKRRREKATMESEGKEALQYNDAIEWFEQMAKSQGTSYDPEVVQLFLSTVAIHTTSDLLTVVMADLARNPEIIEPLREEISSVLRDGGWKKTSLTDMKLLDSVLKESLRLKPIAVVSMRRVAMDHLKLSDGTFLPKGTKMAVSSHRMWDPDVYENPEQWDGFRYVNLRETPGQDKHAQFVSTSERHLGFGHGKHACPGRFFASSELKVALCHILMKYDFELAPGTVVQHRYSGASYYADPAIRVMLRRRNVALPSWFER

SEQ ID NO: 1437 - protein, 560 aa, Talaromyces stipitatus
  misc_feature (1)..(560): Public GI ID no. 242815592
  misc_feature (1)..(560): Talaromyces stipitatus ATCC 10500
  misc_feature (123)..(522): Pfam Name: p450 Pfam Description: Cytochrome P450
  misc_feature (1)..(560): Bit score of 822.4 for HMM based on sequences of Figure 6
  misc_feature (1)..(560): Functional Homolog Of SEQ ID NO. 1429
  misc_feature (1)..(560): in Figure 6
MARNLTVMAAQITGSLPSWAQLPQLKKVIAMPFTNMTTLWGIPVPWVVTGLIAFICILALVQEEDFPHTDYPLQNPRKFWDVTAWKSKWDFIFGVRKILEKRIAEAPDQPYRILTDFGDMTILPPDYANEIRNSDDLSFDRVVEKNFQAHLPGLDVFKEENLHKTVLRHVIRTRLTQFLSKVTAPLSNETALTLQDVFTDQKEWHTIILKDEIVKIVSRISARVFTGEILCRNPEWQKITADYAMTCFLAADMVRMFPKPIRPLVHRILPLSIKVRSDVKKARAIVEPVLAERKKIKEEARRRGEPIPKFDDAIEWCEEIEQDVGFDMATFQLAMAVAAIHTTSDFLTQILLDLAQHPEYIEPLRAEIAAVLKEDGWDKLSLYKMRLLDSVCKETQRLRPIGLVAMHREALKDIDLAGGVHLPKGTRIAISSHRMRDPAYYPSPNEYDGYRFLRMRDELGAGKDGDAHFVTTSPQHLGFGHGKHACPGRFFASNEVKVALCHILLKYNWRLAPGVEPKIFQFGLTIGCDPVAKVEIRRRDYHLEALAGKEEIDVRDLPVK

SEQ ID NO: 1438 - protein, 528 aa, Neurospora tetrasperma
  misc_feature (1)..(528): Public GI ID no. 336468679
  misc_feature (1)..(528): Neurospora tetrasperma FGSC 2509
  misc_feature (166)..(507): Pfam Name: p450 Pfam Description: Cytochrome P450
  misc_feature (1)..(528): Bit score of 835.9 for HMM based on sequences of Figure 6
  misc_feature (1)..(528): Functional Homolog Of SEQ ID NO. 1429
  misc_feature (1)..(528): in Figure 6
MANPSATPSSIPSWMERLDIISITDPSATPFSYLVTAFLLAVVVYSLQGPRFPKNIKHLNPKGPLEFSDTRPKKEFVHGSRPMLANWFKANPNKPCRVISDFGEAIVLPPRMANEIKNDDRLSFTRWTYKAFHGHLPGFEGFGEVSRESHIVQEVIMRDLTKYLNKVTEPLAQETSMAMEAILPKAANGEWSTINLRSKILPIVARISSRVFLGEELCRNVEWLKVTQQYTIDGFGAAEDLRLWPAALRPIVHWFLPSCQRARADVRVARSILDPVLKKRRQEKAANGGKAQHDDAIEWFERTAKGEYYDPAVAQLVLSLVAIHTTSDLTCQVMTNLMQNPEFIGPLREEMIRVLSEGGWKKTSLYNMKLLDSVIKESQRVKPIGVASMRRYAEKDVTLSDGTFIPKGGFVAVSAHDMWNSEVYEQADKWDGRRFLRMRETPGAGKENAAQLVSTAPEHLGFGHGQHACPGRFFAANEIKIALVHLLLNYEWRLPEGSDPKIRTFGFSMGVDPSLKVEYKGRQPEIEL

SEQ ID NO: 1439 - protein, 526 aa, Penicillium chrysogenum
  misc_feature (1)..(526): Public GI ID no. 255956889
  misc_feature (1)..(526): Penicillium chrysogenum Wisconsin 54-1255
  misc_feature (139)..(514): Pfam Name: p450 Pfam Description: Cytochrome P450
  misc_feature (1)..(526): Bit score of 783.2 for HMM based on sequences of Figure 6
  misc_feature (1)..(526): Functional Homolog Of SEQ ID NO. 1429
  misc_feature (1)..(526): in Figure 6
MAVQQIITLFFGHTFPADSTSWPVIAVLLVFFVLTTRNFFSSTKAAGHIPLVNPPKFYDIGAIWAKIDCILHARRLLARGVSSGRPFRLLTDLGEMIVLPAHFATEIRSDPRLSFAEVIEQNFHSRFPGFEGFRMGTTDAHLSRDIANNQLTHTLAKVTEALSEECTAAMTDHFPATKEWAEICLREHVLQLVARLSSRVFLGDAGANNSAWLRITTEYTKTAYIAAYLLRLWPPVLRPFVHWFIPHCRKLRAQVAEARHIIVGIIEQRHQGRVAAELASQPVPQYNDAIEWFEQDFAVTRDGRHDPAVAQLILAQAAIETTTDLLTQVILDLAQHPELIGTLREEVAGAIQEGGWRKSSLYDMKLLDSVLKESQRLKPLAMTSMHRLVLEEITLSDGTLLPKGSVIGVSADRMWNPSVHENPAQFDGFRFQRMRDQPGGSTNQAHLVSTSVNHLAFGHGKHACAGRFFVAHEAKIALTHLLLKYDWKLASTSANAKPMEFGLVLQANPKAKICIRGRQEISKSPF

SEQ ID NO: 1440 - protein, 502 aa, Verticillium dahliae
  misc_feature (1)..(502): Public GI ID no. 346970804
  misc_feature (1)..(502): Verticillium dahliae VdLs.17
  misc_feature (136)..(474): Pfam Name: p450 Pfam Description: Cytochrome P450
  misc_feature (1)..(502): Bit score of 562.0 for HMM based on sequences of Figure 6
  misc_feature (1)..(502): Functional Homolog Of SEQ ID NO. 1429
MSQNETLHGGWLSHPADSFEIQFYRPFFTLILALLVPAAVASLYFKEGDDVSPKWPRLEAQKQKDFLTDGSKYLEDSKKMHSDDPFTMLTDRGMRTVFPAAIADVIRNMTSLRFSKSVADEFHAGLTGFEPFAMLDNPTQVLQRVVRKQLTQRLNWREIKIESSVSELVARISSRVFLGEELCRHEKWLEITQSYTVASFRAAAILRTYPRILRPLVNWFHPNVKVIRGTIAESRRIIGSLVERRQKLRAEAQANGLPVPTFNDAIEWAELEADGYPCDPAVFQLTLSFAAIRTTTDLLTQVMLRLAHEPENIEPLRKEMIEILQVDGWTKNALFKMKLLDSAIKEAQRLKPINMLEMRRMAVEDVTFPDGTLIRKGAHIAINNTSFSRAEVYEDYEKFDIYRFKRMRDEPGKEHTAQLVSTSLNHLSFGHGKFACPGRFFVSNELKLALCHLLLKYDWKSTPGVSHDPLVLGTTIMHNPETSIQFRRRKEEIDLESLEIEE

SEQ ID NO: 1441 - protein, 497 aa, Arthroderma gypseum
  misc_feature (1)..(497): Public GI ID no. 315047883
  misc_feature (1)..(497): Arthroderma gypseum CBS 118893
  misc_feature (119)..(471): Pfam Name: p450 Pfam Description: Cytochrome P450
  misc_feature (1)..(497): Bit score of 564.6 for HMM based on sequences of Figure 6
  misc_feature (1)..(497): Functional Homolog Of SEQ ID NO. 1429
MLEALVQASSGYRVDLALSFVVLLVVSYIARLVSHRQRYSKFPLHADKSNPKQMLLSGFAKYKNAFHIDTAIGKDIILSADYANELKSDPHLDFAKAILPTLLTHLSTFHHIEEAGKNQVLTETIRSKLSRLPVHLKQAVSNEAREVIRNKFTDDEEWHEIPIKETIVKIVARVSSRVFLGEELCRNEEWLRITSEYTVNLFIAINELTTWPASVRPIVQWFLPTCQRLRQQVADARRLIQPVIDGRHAENDELRRQGKPLKQHEDAIAWLDEKAGGRSFDAAIAQLSLSFVSIHTTTDLCTQAIYDICANPELIQPLREEIISVLGSRELDTTALYQMKLLDSVIKESQRLKPAGLLSMKRYATQDVTLSDGLVVPKGTSISVSSHVHWDESVYPEPNKFDGYRFLKMKGDREKDRMANLVATSPEHLGFGHGIHACPGRFFAADEIKILLCHILLKYDFKLPEKSNTTPYILPGGAYMSASAQLDIRRRKEEITL

SEQ ID NO: 1442 - protein, 482 aa, Ajellomyces dermatitidis
  misc_feature (1)..(482): Public GI ID no. 239609926
  misc_feature (1)..(482): Ajellomyces dermatitidis ER-3
  misc_feature (145)..(461): Pfam Name: p450 Pfam Description: Cytochrome P450
  misc_feature (1)..(482): Bit score of 587.9 for HMM based on sequences of Figure 6
  misc_feature (1)..(482): Functional Homolog Of SEQ ID NO. 1429
MLLDTELYSSILNPLGLAGLFILLPTLIFLLASLKAPRLPLINGKKPFELRQIHAGRRFLKDARSLIEEGLRKASAFRLMTENGPKTVLSANYADEIRSHPSLNFGAAIAKEFHADIPGFDTFKQGTRVDEIFQDAVRMKLTHHLDWHDIALKQNVLKLVAQMSSRVFLGKRICRNPDWIRITIAYTIDSYIAALALRLWPATVRSLVSNFIPSCRKLRQEIEEARTIIQPVLDERRMAKEEAIRAGKMPERYVDAMEWLEESAKGRYYDPVIAQLSFSHASIHTTSDLITQTLLDLCGRDELIQEVRDEIVTVMETEGWKKSTLFKLKLMDSVLKETQRLKPIAVATMRRLAEEDTVLSDKTFLPKGELIVVACDKMWDPNIYPNPTTYDPYRFLKLRETPGNETSAQLVSPSPEHLGFGFGKHACPGRFFAANEVKIALCHILLKYDIKLAEGYEPRILPNGLSLNSDHMARISIRRREE

SEQ ID NO: 1443 - protein, 515 aa, Glomerella graminicola
  misc_feature (1)..(515): Public GI ID no. 310799765
  misc_feature (1)..(515): Glomerella graminicola M1.001
  misc_feature (142)..(500): Pfam Name: p450 Pfam Description: Cytochrome P450
  misc_feature (1)..(515): Bit score of 578.3 for HMM based on sequences of Figure 6
  misc_feature (1)..(515): Functional Homolog Of SEQ ID NO. 1429
MESNPSLDLSFGTYTIPSPAEKPIPYLVTAFLFVILVYAVGDRAPKLPEVNPLKAFEFTNRRRNGEFVHQSKEIALKGKAVFGDNPFRMHTEWGEVVVLPPAFMQELRNDPGLEFSDTLVDDAHGYIPGFDPFDGNPAILTIITKYLTKALAKLTKPISKEATLVLRHVLTDSTDWHQITPRDDIIRIVSRLSSRVFMGEEICRDEEWVRVSGFYSGAAFVVGWGLSQWPRWARPIVHWFLPSCWYVRRLLAECRSTLKPHLERRNARKAAALARGEKDPIFDDSIEWFEKECTANYDPVREQITMSLVAIHTTSELLQQTMLDLASHPELFQPLREELVRVLSAEGLTTTAFHNLKLMDSVIKESQRMKPVLLSTWRRFVKEDIELSTGFVLRKGQKIICTNAHMWDSQYYENPQEYDGYRFLKMCGTDEEKLAYLVNTSAKHPAFGYGHHACPGRFFAANELKIALAHLLLKYDWKLPAGCNPQPMPYGMALMPDPSALLLIQRRKEEIDLDS

SEQ ID NO: 1444 - protein, 529 aa, Metarhizium acridum
  misc_feature (1)..(529): Public GI ID no. 322697028
  misc_feature (1)..(529): Metarhizium acridum CQMa 102
  misc_feature (233)..(500): Pfam Name: p450 Pfam Description: Cytochrome P450
  misc_feature (1)..(529): Bit score of 489.5 for HMM based on sequences of Figure 6
  misc_feature (1)..(529): Functional Homolog Of SEQ ID NO. 1429
MAFQSLLGSIDPVSEPSSYHLHCARLWAYVLLALVALYFRMSRRAQQNADFTLANPPKWYELKIVRQIQFLFNGINELDKAREKAKGKPFRLLTNSREIIVLPPSYAEVLNAEDRLSFAKYFADEFDGDGKTPGLEPYTLIADPCKRVPKLVTKRLTRSLTAKDTIPIKMSSEASFAIEYNFGGSVNWQEVTIHQHLLDVIARMVSRLFWDGDEVCRDERWLQIMKEWSVNSVIAAFMINMAPSFARPLIRRFSPIVRRARDDYQAARRFIEPLINVRRQAREKARESGERVLAFDDIVDWIDSENEELTCDPVALQMVLNVAAVHTTAALLTNTISFLASDLSTLEPLRQELVAELRSNGCQTAALHNLKLLDSAIKESLRLKPPGVFGMHRAALQDMRLPNGMHIHKGDRVFVDIPHMRDPDIYESPDTYDVYRFYRMRCQPDQALKAPLVQTSPEHLAFGHGAQACPGRFFAAILSKVVLSHLLLKYDWKLAPDSDLTSLAIGLTKRINPKLKLLFRRRDEEFELR

SEQ ID NO: 1445 - protein, 530 aa, Magnaporthe oryzae
  misc_feature (1)..(530): Public GI ID no. 351639827
  misc_feature (1)..(530): Magnaporthe oryzae 70-15
  misc_feature (170)..(498): Pfam Name: p450 Pfam Description: Cytochrome P450
  misc_feature (1)..(530): Bit score of 520.8 for HMM based on sequences of Figure 6
  misc_feature (1)..(530): Functional Homolog Of SEQ ID NO. 1429
MNSPNQSVQPSSAAYAGPEQPLVSSMFERTPLLGLGLSVAVATLFLGKFLFGGGSSKKLAFPLVKKDGDGYNFLSDALKMVEKGRSQHPGMPFFIEGENGPLAIIPPNMIDDIRSHEDLSFHLTVREDFHDGMPGFEAFTITSRGGGVLQTVISKQLTKYVGVILNNLSDEAAYALHKNFGDDTEWREHTIKPIILDTISRVASRIFLGEDLCRNEEWLELSKGYTIAAFMAARDLRQRPFHLRRLMQWFEPSCKTLRRYRDSSRALILPIVDKRRALRRECIAQGRPLPVFNDCIDWFEEEAAGRDYDAGMIQQAIAATGNHTSSDFTTKFVLILAEHPEVQQEIREEIVRVLGAEGLTKAALANLKLLDSAMKETQRLQPLTTSPMARMATKDIHLANGVCIPKGTPLVIDGSWRLSPDIYENPLEFDAHRFLKWRGTDRENMAHFVSTAASHTGFGHGIYACPGRFFATNELKVILCQLILKYDWKLAEGSTAEPLVFGFNLDASWDAKIMVRRRKVVELDIDALSA

SEQ ID NO: 1446 - protein, 527 aa, Glomerella graminicola
  misc_feature (1)..(527): Public GI ID no. 310801951
  misc_feature (1)..(527): Glomerella graminicola M1.001
  misc_feature (152)..(498): Pfam Name: p450 Pfam Description: Cytochrome P450
  misc_feature (1)..(527): Bit score of 640.1 for HMM based on sequences of Figure 6
  misc_feature (1)..(527): Functional Homolog Of SEQ ID NO. 1429
MASEPLASPLPGNCALTTAGSLRHSPETWSFLVVILASILAYRIWSDRKFKLPPLINPLQSFDLTGAGVKKDFIQRSSKLIDEGSRRFGDQPYSLMSDVRHVIILSPKHVDEIWNNPKLSFLKNTEDEFHAYLPGFEPFGAGRAIQILIMVAKKQLTKFLAKITKPLSDETAFSFHTVLGDSPEWQEVGLRKTILSVVSRLSSQVFLGADICRNQAWLNTTVMYAVDSFVAAKRLRIFPKPLRQVVHWFLPECQRVRSHIDEARSIIQPVIDGQARKKREASSQGRPVPTYDNAIKWGKEESARSKYDPAIYQLALAGAAIHTTTDLLSHVILNILSHPELIPALQAEMIEVLGKEGWAKTSLYNLKLMDSVMKETQRLKPVSLVSMGRIAEADVHLSDGTVIPKGMKCAVANTSRHDPAVYERPDEFDGYRFLRMRRTPGKENQAHFVTTGPDSLGFGHGQHACPGRFFAANEVKIALCHFLLKYEVELAPGSDSSVQVHGFSLNFNRQARIRVRRRTKEINLDDL

SEQ ID NO: 1447 - protein, 506 aa, Aspergillus niger
  misc_feature (1)..(506): Public GI ID no. 317035847
  misc_feature (1)..(506): Aspergillus niger CBS 513.88
  misc_feature (151)..(492): Pfam Name: p450 Pfam Description: Cytochrome P450
  misc_feature (1)..(506): Bit score of 712.9 for HMM based on sequences of Figure 6
  misc_feature (1)..(506): Functional Homolog Of SEQ ID NO. 1429
MENMLGYTSMPVPVLVSLALGLAFLLLQSFRYKDPALNPKKPFELTSTRVKQEYFSNARRLLWDWFTTHSNTPVLLHTDTGKVTILPPSMANEIRNDDRLSFSRWTFEAFHGNLPGFDGFREGSQDSGIVQAVIGNDLTKYPNKVTEPLANETSVAVRELLTDNEEWHTIQLRTVMVALISRISSRVFLGEKLCRNEEWLRVTQDYTTDGFLAAEELRMWPAAIRPIVHWFLPRCRKLRAQVKVARKVMGPILEERRQFKKHLHAEGKQSQGFDDAIEWFEKAAKGRPYDPVSAQLILSVAAIHTTSDLTSQTMTHLVQNPEILEPLRKEIVDTLQQHGWKKTALYNMKLLDSVIRESQRLKPINNASMRRVALKEVKLSDGTVIPKNGMLAVSAHKLWDDDTYENAAAWDGYRFYKMREDPERQTKAQLVTTAPENLAFGHGKHACPGRFFAANEVKIALIYLLLRYDWKLLEGTVPKIRYGGFSMAVDPSLKMEVKRRREEMGI

SEQ ID NO: 1448 - protein, 513 aa, Aspergillus niger
  misc_feature (1)..(513): Public GI ID no. 317033079
  misc_feature (1)..(513): Aspergillus niger CBS 513.88
  misc_feature (148)..(492): Pfam Name: p450 Pfam Description: Cytochrome P450
  misc_feature (1)..(513): Bit score of 556.4 for HMM based on sequences of Figure 6
  misc_feature (1)..(513): Functional Homolog Of SEQ ID NO. 1429
MELKVDVKEHGNPLSLGTSIILLSLVLIFLLRWKDTPASQNGLPLINAKRRFEFVDLLAKKRFITNAQELLKAGLKKASVFNIVTENGVMMVLDPKYADEIRNSKILSLRKTLIEDMHVNVPGFEQQMQALEDDEIFQTTLKTKLTRNLEDLNEILSQEATVALQEHWTDNPEWHEIPLSRSMLKIIAQLSSRVFLGDKICHNPKWLRISVDYSIDLFQATFELRIYPRFLRPLASRFQPSCRRLRADIREARSIIEPVIEERRKAKAIAKQEGRDPERHEDTIEWLEEVANGRQYNPVSAQLLLSSAAVHTSSDMLTQVLYDLDGRQELIEALREEIRSVFKNGWERSSLAKLRLMDSMLRESQRLKPISSVSMRRMAEAPVTLSDGTIIPKDCKIIVPCLRQWDEKYYPDPETFVPDRFLKLRNEPGYEHTAAFANSSPNHLGFGLGRHACPGRFFAANEIKLALCHILMKYEFRVVGKKPEKVVFGTMLAADPNGVIAVRRRKGEEQIRL

SEQ ID NO: 1449 - protein, 541 aa, Magnaporthe oryzae
  misc_feature (1)..(541): Public GI ID no. 39975659
  misc_feature (1)..(541): Magnaporthe oryzae 70-15
  misc_feature (172)..(506): Pfam Name: p450 Pfam Description: Cytochrome P450
  misc_feature (1)..(541): Bit score of 557.5 for HMM based on sequences of Figure 6
  misc_feature (1)..(541): Functional Homolog Of SEQ ID NO. 1429
MASSVHADSGWLRKQVMGSSGLELLDSSRFTIGITLAALVLLPVVASYLTGARKGKEAPLVNPPGLFQLAVQKNIEFVHKGNYYLKEARRRFPNQPFKLLTNGGPMTVLPPSRSNEIKNMESLDFRKVLSYAAPVNLPGGSAIAAVDHPQAIIQTVITKNLTKRLNTVTGPLADEASFAINKNFGSNPDWVEAKICEPITDVVARLSSRVFLGEEICRNEEWVDLTKKIAIVVLTCIYTLRAFPQWMMPIVYTFGKAGKDMRAMRTRVIEIIHPIIDKREQEKAECKAQGIPAPVYNDAIEWVAAEADPNDPVFKLGDFQIGLSVAAIHTSSDLLGYTLLWLAASDPAYIDALRKEIVEVLGKKGWKKTSLVSMKLLDSTIKEAQRLKPVQLAIMQRRAMKDIESEGGVTVRKGELVAIDSNRLRDPAYYPNPDTFDPYRFYNARKQPGGEHKAQFVSVTPDHLTFGYGKYACPGRFFAANEIKLALCHLLLKYDWKLPEKAPPKPLIIGIDPLVDPEARLLFRRRKEEIDLDSLDVENEE

SEQ ID NO: 1450 - protein, 527 aa, Leptosphaeria maculans
  misc_feature (1)..(527): Public GI ID no. 312212422
  misc_feature (1)..(527): Leptosphaeria maculans JN3
  misc_feature (168)..(499): Pfam Name: p450 Pfam Description: Cytochrome P450
  misc_feature (1)..(527): Bit score of 582.5 for HMM based on sequences of Figure 6
  misc_feature (1)..(527): Functional Homolog Of SEQ ID NO. 1429
MHSPLSMPPPGSWLSTASTELARVQVPLWLTTSIICGLIYYISTTLSNKTPLPYINTPKWFIPEVVEQINFVKNGMKTLARGRTELKDKPYRMITHMGEVTVLPPSYATIIRNEETLDLRSLLAKDFHSHLPGFEPVGAVAKYLHRIVHRYLNKHLNTVTAHIPAEATYAINLLFKNPSDWSEVCIREKNVELVTRLSSRVFLGPELCRNEDWLKTAIDYTNHSGGAAIKLNLLPSFLRPFFTWFSNDCKHVRSDLDKARAIINPVVEARRQQKRRAQAEGKPAPVFTDVIEWAEIEGGEEEYDAAIAQLGFAAAAVHTTTDLLTQTMLHLANDPKQIEPLREEITRVLTTEGWKRNALFNMKLLDSAIKEAQRWKPINMLAMRRIALHDITIPGGLTIRKGERIGIDAFNMLDPKIHPNPEKYDMYRFLRMREAHPDHAIKAQLVSTSPEHLEFGHGHFACPGRFLAADEIKIALCHLLLKYDWKFAEGTSLEYIQAAFFQNVNPANMLLYRRRKEEIDLETVKLN

SEQ ID NO: 1451 - protein, 505 aa, Magnaporthe oryzae
  misc_feature (1)..(505): Public GI ID no. 145606901
  misc_feature (1)..(505): Magnaporthe oryzae 70-15
  misc_feature (144)..(473): Pfam Name: p450 Pfam Description: Cytochrome P450
  misc_feature (1)..(505): Bit score of 521.1 for HMM based on sequences of Figure 6
  misc_feature (1)..(505): Functional Homolog Of SEQ ID NO. 1429
MFERTPLLGLGLSVAVATLFLGKFLFGGGSSKKLAFPLVKKDGDGYNFLSDALKMVEKGRSQHPGMPFFIEGENGPLAIIPPNMIDDIRSHEDLSFHLTVREDFHDGMPGFEAFTITSRGGGVLQTVISKQLTKYVGVILNNLSDEAAYALHKNFGDDTEWREHTIKPIILDTISRVASRIFLGEDLCRNEEWLELSKGYTIAAFMAARDLRQRPFHLRRLMQWFEPSCKTLRRYRDSSRALILPIVDKRRALRRECIAQGRPLPVFNDCIDWFEEEAAGRDYDAGMIQQAIAATGNHTSSDFTTKFVLILAEHPEVQQEIREEIVRVLGAEGLTKAALANLKLLDSAMKETQRLQPLTTSPMARMATKDIHLANGVCIPKGTPLVIDGSWRLSPDIYENPLEFDAHRFLKWRGTDRENMAHFVSTAASHTGFGHGIYACPGRFFATNELKVILCQLILKYDWKLAEGSTAEPLVFGFNLDASWDAKIMVRRRKVVELDIDALSA

SEQ ID NO: 1452 - protein, 514 aa, Sordaria macrospora
  misc_feature (1)..(514): Public GI ID no. 336263834
  misc_feature (1)..(514): Sordaria macrospora k-hell
  misc_feature (168)..(496): Pfam Name: p450 Pfam Description: Cytochrome P450
  misc_feature (1)..(514): Bit score of 767.0 for HMM based on sequences of Figure 6
  misc_feature (1)..(514): Functional Homolog Of SEQ ID NO. 1429
MANPLATPSSIPSWMERFDIKSFPDPSAKPFPYLVTAFLLIVIVYSLQGPRYPKNIKHLNPRAPLEFSDTRPKKEFVANSREMIANWFKTNPDKPCRVISDFGEITVLPPRFANEIKSDDRLSFSKWTYKAFHAHLPGFEGFREGSRDSQIVQEVIMRDLTKYLNKVTEPLAEETSLAIEEILPKPANGEWSTVNIRSKVLPIIARISSRVFLGEELCRNEEWLKVTQQYTMDAMRAAEELRLWPAVLRPIVNYFLPSCQRTRAHVAVARKIIDPVLQKRRQEKAANGGKAEHDDAIEWFERTAKGKYYDPAVAQLVMSMAAIHTTSDLTCQVMTNLMQYPEYIAPLREEMISVLSEGGWKKTSLYNMKLLDSVIKESQRVKPIGMVSMRRYVDKDLRLSDGTLIPKGGIVAVSAHNMWNSEVYDQPGKWDGRRFLKMRETPGAGKENVAQLVSTGPDHLGFGHGQHACPGRFFAANEVKIAVIYLLLNYEWRLPEGLIPRSGRLASRWGWIRF

SEQ ID NO: 1453 - protein, 497 aa, Aspergillus niger
  misc_feature (1)..(497): Public GI ID no. 350636399
  misc_feature (1)..(497): Aspergillus niger ATCC 1015
  misc_feature (141)..(483): Pfam Name: p450 Pfam Description: Cytochrome P450
  misc_feature (1)..(497): Bit score of 716.8 for HMM based on sequences of Figure 6
  misc_feature (1)..(497): Functional Homolog Of SEQ ID NO. 1429
MPVPVLVSLALGLAFLLLQSFRYKDPALNPKKPFELTSTRVKQEYFSNARRLLWDWFTTHSNTPVLLHTDTGKVTILPPSMANEIRNDDRLSFSRWTFEAFHGNLPGFDGFREGSQDSGIVQAVIGNDLTKYLNKVTEPLANETSVAVRELLTDNEEWHTIQLRTVMVALISRISSRVFLGEKLCRNEEWLRVTQDYTTDGFLAAEELRMWPAAIRPIVHWFLPRCRKLRAQVKVARKVMGPILEERRQFKKHLHAKGKQSQGFDDAIEWFEKAAKGRPYDPVSAQLILSVAAIHTTSDLTSQTMTHLVQNPEILEPLRKEIVDTLQQHGWKKTALYNMKLLDSVIRESQRLKPINNASMRRVALKEVKLSDGTVIPKNGMLAVSAHKLWDDDTYENAAAWDGYRFYKMREDPERQTKAQLVTTAPENLAFGHGKHACPGRFFAANEVKIALIYLLLRYDWKLLEGTVPKIRYGGFSMAVDPSLKMEVKRRREEMGI

SEQ ID NO: 1454 - protein, 505 aa, Neosartorya fischeri
  misc_feature (1)..(505): Public GI ID no. 119485937
  misc_feature (1)..(505): Neosartorya fischeri NRRL 181
  misc_feature (134)..(481): Pfam Name: p450 Pfam Description: Cytochrome P450
  misc_feature (1)..(505): Bit score of 543.0 for HMM based on sequences of Figure 6
  misc_feature (1)..(505): Functional Homolog Of SEQ ID NO. 1429
MPLGSNWARGLAIILFLGPLTLLLVSSYLFPSTLTVINSGRAWDVFRTTAKKRFRSDAARLLQNGFEKSPDAFRILTDNGPLLVLSPRYAREVRSDDRLSLDHFIASEFHPDIPGFEPFKLILDPRNPLNTILKTSLTQALAYMTEDLSVEVADALSTTLTDDSEWHEISPCQTALKLVAQMASKAFIGQEKCRDPKWHNIIITYTHNVYLAAQALHFWPKFLRPIVARFLPACQTLQAQIAEAREILEPLVAQRRADRASRAAQDKPVPSRADVIDWLENSYGDQPYDAVAAQLLLSFAAIHGTSNLLAQALMDLCTDPDLIRDIRAEIISVLGDEGLTRVALYRLKLMDSALKESQRLAPNRLLSMGRIAQSDMHLSDGLRIPRGTTLMVSAHTMWEPEIYPDPRRYDGYRFYKLRQASGQEGQHQLVSATEKHMGFGYGKHACPGRFFAAAEIKAALCHILLKYDLEHRDGQPPRVWSQGIHLFPDPTARIHVRRRKEEISL

SEQ ID NO: 1455 - protein, 509 aa, Gibberella zeae
  misc_feature (1)..(509): Public GI ID no. 46118584
  misc_feature (1)..(509): Gibberella zeae PH-1
  misc_feature (147)..(481): Pfam Name: p450 Pfam Description: Cytochrome P450
  misc_feature (1)..(509): Bit score of 568.8 for HMM based on sequences of Figure 6
  misc_feature (1)..(509): Functional Homolog Of SEQ ID NO. 1429
MSTYIDIVLENPQYAVLSTISLIAILIANYSFFAKDDKYPVLNPKKPFEWSNTRVVKEFTENSKSLLAHARSVYGEQPYRAYTDMGKVLVIPPSWVHALRSKKELDFRIPAQEDSHEYIPGFDGFGFHANMPTVITKYVTKSLAKMTGPISEETSLSIRDRLTDSKEWHSINPPKEMIRIVSRVSSRIFMGKELCRDEAWTKASSDYTVVAFASIALLRVYPRWLRPYIHWFLPYCKEARRLLKEARECLQPHLDRREVIKQQALAQGQPCPFDDAIEWFNNEYDKHDPATQQISISIVAYHTTSDLLCETLLNLCQHPELFKPVRDEIITVLRQEGGITKAALYNMKLLDSVIKESQRLRPILLGAFRRKAMADVTLPNGDVLRKGDRVIGETTHMWGPESYDNALEFDPYRYVRMRESGEENKAHLVSTSPEHLGFGHGVHACPGRFLAANEIKILLCHLLLKYDWKLPEGAEPKPSFASFRIDGDKTTNLLIRRRTEELDIDSLSA

SEQ ID NO: 1456 - protein, 522 aa, Chaetomium globosum
  misc_feature (1)..(522): Public GI ID no. 116203015
  misc_feature (1)..(522): Chaetomium globosum CBS 148.51
  misc_feature (169)..(497): Pfam Name: p450 Pfam Description: Cytochrome P450
  misc_feature (1)..(522): Bit score of 682.1 for HMM based on sequences of Figure 6
  misc_feature (1)..(522): Functional Homolog Of SEQ ID NO. 1429
MMAQPSSFPGVASFEGLRAWVDDPTTIPVPAPYFLAAAFALAAIFLFLGQKSASNIPHLNPRKLLEVTDIRSKKEFLFGSRSMLSDWFRDHPDKPARVIGDAGEVTILPPHLTNEIRNDPRLSFSRWVFKVRPDPALVRSGFREGSRESHIVQDVIVKDLTKYLNKVTEPLAEETTLAVEEQYPASNGQAPLRETLLRVVSRVSSRVFLGEELCRNQDWLRVTREYTVDGFRAADELRLWPAPLRYLVHWFMPSCARARADVREARRVLNGVISKRRARKQRGEKVEFDDAIEWFEREAKGRAYDPVVVQLTLSFAAIHTTTDLITQVMTDLCRNPEIIDELRQEMVQALSEGGWKKTSLYNMKLLDSVIKESLRIKPTGIVSLRRMTSEPMHFSDGTFVPANATIAVTAQNMWNPTIYPNPQQWDGRRFLRMRETAGQENAAQLVTTSPEHLGFGHGKHACPGRFFASNEAKVVLVHLLLKYDWRLPEGAPTPRVLHYAFSLRADPTVRLEYRRRTPEIEI

SEQ ID NO: 1457 - protein, 539 aa, Magnaporthe oryzae
  misc_feature (1)..(539): Public GI ID no. 351648588
  misc_feature (1)..(539): Magnaporthe oryzae 70-15
  misc_feature (182)..(515): Pfam Name: p450 Pfam Description: Cytochrome P450
  misc_feature (1)..(539): Bit score of 559.7 for HMM based on sequences of Figure 6
  misc_feature (1)..(539): Functional Homolog Of SEQ ID NO. 1429
MASSINASPTWPQGQLPGLSALASLDLDRSTIAITLAAIVILPLLVSYIASSLRGEKVPVVNPPGRFQTALQKSIEFGTAGFKIFQQAQEQFPNQPFKLLSNAGYTTVLPPDRALEVKQHPNLSFRKAFSTILPANSEGAAALGVVDHPSEIIQKIVTKHLTKRLNSVTAPLSLETSVATEKNFGKSSEWTEIKVYEPITDVIARVSSRVFLGDKLCRDAAWLDITKSFAQTAMAVIMTMRAFPTWIRPLVFQFASYGKEYRALYRRGHNAIMPIMKERQEERAECAAKGVPAPVYNDLIEWAETEAGNNSFDMTAVQLSISMAAIHTTSDLVSQNILLLSTRPDFVDALRKEMIEVLPAKGWKKTSLTSLRLLDSAIKEAQRLKPTSVIGMQRLVMKDTVLEGGITLRKGEYSAVDATRVWDPKLHKNPDEFDIYRFYEARKQPGGEHVHQLVSTSPDHIAFGLGKYACPGRFFASNETKVVLCHLLLKYDWKLAEGSSTDFTYFGTELTINPETKVLYRRRKEEFDLDALATDEEAS

SEQ ID NO: 1458 - protein, 505 aa, Ajellomyces dermatitidis
  misc_feature (1)..(505): Public GI ID no. 327350850
  misc_feature (1)..(505): Ajellomyces dermatitidis ATCC 18188
  misc_feature (141)..(484): Pfam Name: p450 Pfam Description: Cytochrome P450
  misc_feature (1)..(505): Bit score of 630.1 for HMM based on sequences of Figure 6
  misc_feature (1)..(505): Functional Homolog Of SEQ ID NO. 1429
MLLDTELYSSILNPLGLAGLFILLPTLIFLLASLKASRLPLINGKKPFELRQIHAGRRFLKDARSLIEEGLSKASAFRLMTENGPKTVLSANYADEIRSHPSLNFGAAIAKEFHADIPGFDTFKQGTRVDEIFQDAVRMKLTHHLGNVIEPISDEIGIVLERDWTNNRDWHDIALKQNVLKLVAQMSSRVFLGKRICRNPDWIRITIAYTIDSYIAALALRLWPATVRSLVSNFIPSCRKLRQEIEEARTIIQPVLDERRMAKEEAIRAGKMPERYVDAMEWLEESAKGRYYDPVIAQLSFSHASIHTTSDLITQTLLDLCGRDELIQEVRDEIVTVMETEGWKKSTLFKLKLMDSVLKETQRLKPIAVATMRRLAEEDTVLSDKTFLPKGELIVVACDKMWDPNIYPNPTTYDPYRFLKLRETPGHETSAQLVSPSPEHLGFGFGKHACPGRFFAANEVKIALCHILLKYDIKLAEGYEPRILPNGLSLNSDHMARISIRRREE

SEQ ID NO: 1459 - protein, 515 aa, Aspergillus niger
  misc_feature (1)..(515): Public GI ID no. 134082570
  misc_feature (180)..(501): Pfam Name: p450 Pfam Description: Cytochrome P450
  misc_feature (1)..(515): Bit score of 688.3 for HMM based on sequences of Figure 6
  misc_feature (1)..(515): Functional Homolog Of SEQ ID NO. 1429
MENMLGYTSMPVPVLVSLALGLAFLLLQSFRYKDPALNPKKPFELTSTRVKQEYFSNARRLLWDWFTTHSNTPVLLHTDTGKVTILPPSMANEIRNDDRLSFSRWTFEAFHGNLPGFDGFREGSQDSGIVQAVIGNDLTKYPNKVTEPLANETSVAVRELLTDNEGRQSHTFQFDDRNANLRTVMVALISRISSRVFLGEKLCRNEEWLRVTQDYTTDGFLAAEELRMWPAAIRPIVHWFLPRCRKLRAQVKVARKVMGPILEERRQFKKHLHAEGKQSQGFDDAIEWFEKAAKGRPYDPVSAQLILSVAAIHTTSDLTSQTMTHLVQNPEILEPLRKEIVDTLQQHGWKKTALYNMKLLDSVIRESQRLKPINNASMRRVALKEVKLSDGTVIPKNGMLAVSAHKLWDDDTYENAAAWDGYRFYKMREDPERQTKAQLVTTAPENLAFGHGKHACPGRFFAANEVKIALIYLLLRYDWKLLEGTVPKIRYGGFSMAVDPSLKMEVKRRREEMGI

SEQ ID NO: 1460 - protein, 507 aa, Aspergillus flavus
  misc_feature (1)..(507): Public GI ID no. 238507153
  misc_feature (1)..(507): Aspergillus flavus NRRL3357
  misc_feature (138)..(489): Pfam Name: p450 Pfam Description: Cytochrome P450
  misc_feature (1)..(507): Bit score of 638.3 for HMM based on sequences of Figure 6
  misc_feature (1)..(507): Functional Homolog Of SEQ ID NO. 1429
MLGDLFESVLTNNSVTLLITVAVAAIALHLSSPKSNLPLVNDKKPWEFRYTKARKRFLANAHNLIKAGLAKAPAFRIVTGNGKRVVLDAKYANELRSHDDLSFGLHTANYFHAHISGFQPFKQGSNDDEIYQNAVRMKLTQSLGNLTQPLVDETLVALQTYWTDDTNWHAIPLKSNIQKVVAQLSSRIFLGDQICRNPNWLRITVDYTVDAFKAAEELRLWPKAFRAIVALFLPSCRKIRAELQEAQDIIRPVLDARRKDKQAALSAGKEPERYNDAMQWLEECAKGRSYEPAFGQLTFSVAAIHTTSDMLTQVLYDLCGRDALIQALREEVITVVQEEGWTKPTLYKLKLMDSVLKEIQRLKPISVVSMQRVATADLRLSDGTFIPKGTFLAVSSDRMWDSEIYPNPLEFDGYRFLKLRELPGHETSAQVVSPSPEHMGFGFGRHACSGRFFAINEVKIALCHSLLKYEFKLADGSVPRATKFGFSFKSDPTTKLMIRRRQEETVL

SEQ ID NO: 1461 - protein, 505 aa, Aspergillus niger
  misc_feature (1)..(505): Public GI ID no. 350631552
  misc_feature (1)..(505): Aspergillus niger ATCC 1015
  misc_feature (146)..(492): Pfam Name: p450 Pfam Description: Cytochrome P450
  misc_feature (1)..(505): Bit score of 552.7 for HMM based on sequences of Figure 6
  misc_feature (1)..(505): Functional Homolog Of SEQ ID NO. 1429
MELKVDVKEHGNPLSLGTSIFLLSLVLLFVFRWGDTPASQNGLPLINAKRRFEIVDLLAKKRFITNAQELLKAGLEKASVFNIVTENGVMMVLDPKYADEIRNSKTLSLRKTLIEDMHVNVPGFEQQMQALEDDEIFQTTLKTKLTRNLEDLNEILSQEATVALQEHWTNNPEWHEIPLSRSMLKIIAQLSSRVFLGDKICHNPKWLRISVDYSIDLFQATFELRIYPRFLRPLASRFQPSCRRLRADIREARSIIEPVIEERQLAKAIAKQEGRDPERHEDTIEWLEEVANGRQYNPVSAQLLLSSAAVHTSSDMLTQVLYDLDGRQELIEALREEIRSVFENGWERSSLAKLRLMDSVLKESQRLKPISSVSMRRMAEAPVTLSDGTLIPKDCKVIVPCLRQWDEKYYPDPETFIPDRFLKLRNEPGYEHTAAFANSSPNHLGFGLGRHACPGRFFAANEIKLALCHILMKYEFRVVGKKPEKVVFGTMLAADPNGVIAVRRR

SEQ ID NO: 1462 - protein, 505 aa, Ajellomyces dermatitidis
  misc_feature (1)..(505): Public GI ID no. 261198797
  misc_feature (1)..(505): Ajellomyces dermatitidis SLH14081
  misc_feature (141)..(484): Pfam Name: p450 Pfam Description: Cytochrome P450
  misc_feature (1)..(505): Bit score of 630.4 for HMM based on sequences of Figure 6
  misc_feature (1)..(505): Functional Homolog Of SEQ ID NO. 1429
MLLDTELYSSILNPLGLAGLFILLPTLIFLLPSLKASRLPLINGKKPFELRQIHAGRRFLKDARSLIEEGLSKASAFRLMTENGPKTVLSANYADEIRSHPSLNFGAAIAKEFHADIPGFDTFKQGTRVDEIFQDAVRMKLTHHLGNVIEPISEEIGIVLERDWTNNRDWHDIALKQNVLKLVAQMSSRVFLGKRICRNPDWIRITIAYTIDSYIAALALRLWPATVRSLVSNFIPSCRKLRQEIEEARTIIQPVLDERRMAKEEAIRAGKMPERYVDAMEWLEESAKGRYYDPVIAQLSFSHASIHTTSDLITQTLLDLCGRDELIQEVRDEIVTVMETEGWKKSTLFKLKLMDSVLKETQRLKPIAVATMRRLAEEDTVLSDKTFLPKGELIVVACDKMWDPNIYPNPTTYDPYRFLKLRETPGHETSAQLVSPSPEHLGFGFGKHACPGRFFAANEVKIALCHILLKYDIKLAEGYEPRILPNGLSLNSDHMARISIRRREE

SEQ ID NO: 1463 - protein, 538 aa, Magnaporthe oryzae
  misc_feature (1)..(538): Public GI ID no. 351640230
  misc_feature (1)..(538): Magnaporthe oryzae 70-15
  misc_feature (191)..(508): Pfam Name: p450 Pfam Description: Cytochrome P450
  misc_feature (1)..(538): Bit score of 542.5 for HMM based on sequences of Figure 6
  misc_feature (1)..(538): Functional Homolog Of SEQ ID NO. 1429
MASSSKLDLAWLQKQPVGQGFLEMSQSTIAVTLAALVLVPVIASYIFAGRKGAAEIPLMNPPGPFELALSKAVQFPQQGLDLYNKARKLFPDQPVKFITNAGTLTILPSDRAQEVKGIRSLDFRKSFSYSAPLTAPGGAALSTFDHPNEIVQTVVSKYLTKRLNTVTGPLASEATFTINKNFGNSPEWTEVKMYDVGLDVVARLSSRVFLGSEICRNEEWLETTKRITMVFTSVLQTARVYPTWLRPLVYRFGKHGRDMMAVTKQVNDIVNPIVEKRKLEMAECEARGEPAPVYNDAIEWILSEHDPNDRIFKVADFQIALSVAAVHTTSDLLSHTMLTLAANPQHIEPLRKEMIEVLGTGGWKKTSLTSLRLLDSAVKEAQRIKPVQRVSMQRLVTEDTTIEGGYRLRKGELVGVDTYPLRDPAKWPEPETFDPYRFYQARKQPGGEHKAQLVSVSPDHLTFGYGKYACPGRFFAANEVKLALCHLLLKYDWKLPEGGSDQPIMFGLDPIVNPGATIMFRRRKEELDLDSLLVDSEE

SEQ ID NO: 1464 - protein, 534 aa, Fusarium oxysporum
  misc_feature (1)..(534): Public GI ID no. 342887718
  misc_feature (1)..(534): Fusarium oxysporum Fo5176
  misc_feature (138)..(511): Pfam Name: p450 Pfam Description: Cytochrome P450
  misc_feature (1)..(534): Bit score of 590.5 for HMM based on sequences of Figure 6
  misc_feature (1)..(534): Functional Homolog Of SEQ ID NO. 1429
MRGISIHQAQDRTVEEFSNCQSSLMSSYLDLLLGNPQYAIFCGVTLFTLFVIRYSLLGHVTKFPVLNPKKSLELTSNRATQDFIADSKNILTNGRALYKDQPYRAYTDWGKVVVIPPKFLDALKSHKQLDFTIPAEDDSHAYVPGFDPFVSDPNISKVVTKYLTKSLTKLTAPLSEEASLAFRQVLTDSTEWHEMHPQHDIVRIVSRMSSRVFMGESLCRDDEWVRASGDYTVQSFKTGDILRTYPRWSRPFVHWLLPSCWTLRKKLAEAIQCLKPHLERRSVISAEAEAQGKPSPFDDSIEWYKKEGSTRNPALLQISLSLVAIHTTSDLLMETLFNIAQHPDLFQPLREEITDVLTTEGLKKTALYNLKLMDSVIKESQRLRPVLLGSFRRQAMADITLPNGDVIKKGEKIVCDTTHMWNGDYYEEAAKFDGYRFLRMREASEQDKHPHLVSTSFDHLGFGHGNHACPGRFFAANEIKIALCHMLLKYDWKLADGVVPKPSGFGMAYLPDLQAKLLIRRRTEELDIDSIETY

SEQ ID NO: 1465 - protein, 486 aa, Aspergillus terreus
  misc_feature (1)..(486): Public GI ID no. 115391085
  misc_feature (1)..(486): Aspergillus terreus NIH2624
  misc_feature (150)..(459): Pfam Name: p450 Pfam Description: Cytochrome P450
  misc_feature (1)..(486): Bit score of 584.9 for HMM based on sequences of Figure 6
  misc_feature (1)..(486): Functional Homolog Of SEQ ID NO. 1429
MLDTVTELPRWDLISLIGLSVISTLFFLLSPFQRSPFPLINGKGTLELSSSNAKKRFLADAGNLIKIGLSKASVIRLVSDNDVKTVLHPKYVNDIRSHPALSFGTAIQKEFHADAGIHGFEPFKQGSTAGEIFQYAVRTKLTQSLEWHEVDLRASILGIVAQLSSRVFLGDQICRNPDWLRITVNYTVDSFIAAQDLRLWPKPLRPLVANFLPSCRKIRSELREATEIITPVLEERRKSKETQVREGRTPERYVDAMQWMEESAEGRPYDPAVAQLSFSLAAIHTTSDMLTQALLDLCGKDDLIKELREEIVTVIQGEGWKKTTLYKLKLMDSVLKESQRLKPVSIASMRRLASEDVKLSDGTIIPKGSSLFVSSDNMWDPSVYPDPEKFDPYRFLRLREIPGHETSAQLVSPSPEHMGFGFGKHACPGRFFAVNEIKIALCHILLKYDIRLPEGYTPAKRRMGISLDVDPLARLLVKRRQEEILL

SEQ ID NO: 1466 - protein, 512 aa, Penicillium chrysogenum
  misc_feature (1)..(512): Public GI ID no. 255950818
  misc_feature (1)..(512): Penicillium chrysogenum Wisconsin 54-1255
  misc_feature (139)..(484): Pfam Name: p450 Pfam Description: Cytochrome P450
  misc_feature (1)..(512): Bit score of 607.7 for HMM based on sequences of Figure 6
  misc_feature (1)..(512): Functional Homolog Of SEQ ID NO. 1429
MAVDKLPLLAKFEPVSLVGLVLLSGLFLLLTASRKSDLPLVNGKRPFEFGIAKARQRYLKNAHNLITAGLAKVCNSAGAFRIVTENGTRTILSPNYADDIRSHRDLSLSAALVKEHHVNIAGFDAVKVTVTSDIIQDTVRTKLTQNLLNITEPMSEEATILLKEQWTDNTDWHDVALRPKTLGIVAQLSSRVFLGDKVCRNPDWLRITVNYTIDSLMAAAELRLWPEMLRPLAARFLPKCKKIRKQLEEARDIIQPVIDERRLAQQEAIKQGKPQERYHDAIQWLAENTKDRSFEPAAMQLALSTAAIHTTTDLLGQTVLDLCGRDELIQELREEIISVFKDGSWDKSTMYKLKLMDSVIKESQRVKPMAIAKMARCAEEDVKLSDGTIIPKGEIILVSCSKMWDANVYPDPNTFDPHRFLKMRQPGSDQESFAQLVSPSPEHMGFGFGKHACPGRFFAAAELKVALCHIIMKYDFKVADGCNPQVLKSGMRLAADPFAKIAIRRRQEEVTF

SEQ ID NO: 1467 - protein, 494 aa, Aspergillus nidulans
  misc_feature (1)..(494): Public GI ID no. 67903086
  misc_feature (1)..(494): Aspergillus nidulans FGSC A4
  misc_feature (143)..(469): Pfam Name: p450 Pfam Description: Cytochrome P450
  misc_feature (1)..(494): Bit score of 604.2 for HMM based on sequences of Figure 6
  misc_feature (1)..(494): Functional Homolog Of SEQ ID NO. 1429
MDSLSLSNSQSIAGVLALLLLSGIYVYLNSPSYPVVNGKRPWELRIIHAQKRFLSNARDLIDSGLARWPAFHLVTEAGYRLVLDPKYANEIRSHEALSFGKATAQDFHAGIHGFEPFEQGTRSDQIVSDVVRMKLTQSLGNVTKPLSDETAIALQKNWTDEADWHTIPVKKTVLDIVAQLSSKVFLGDQICRNPEWLRITVAYTVDSFLAAQALRMWPTFMRRLVAPFIPGVQKIRAELEEARRIILPVLEKRKAEKQTAIAAGKTPARYNDAMEWMEQCAKGRPYDAAVSQLSLSLGAIHTTSDMLTQVLYDICGHSDLVDELRQEVLTVIAAEGWQKTTLYKLKLMDSVLKESQRVKPIGIVKLSDGTVIPKNANLIVSSQRMWDESIYPSPDKFDPYRFLRLRETPGHETSAQFVSPSPDHMGFGFGKHSCPGRFFAANEIKIALCHILLKYDFRLTEEWRNPRPIASGAGLTAEPRATMEIRRRKEEIQL

SEQ ID NO: 1468 - protein, 520 aa, Verticillium dahliae
  misc_feature (1)..(520): Public GI ID no. 346973227
  misc_feature (1)..(520): Verticillium dahliae VdLs.17
  misc_feature (250)..(494): Pfam Name: p450 Pfam Description: Cytochrome P450
  misc_feature (1)..(520): Bit score of 643.2 for HMM based on sequences of Figure 6
  misc_feature (1)..(520): Functional Homolog Of SEQ ID NO. 1429
MESSSSAPTQPPLLGSWAESTPMAQLDAQQLPYLDLALVVVLASCARAQGSKEDRIPCLNPSRRPLIFGKDPAASKSFTANARGILAEGRKRFPGQPFRITSDSGETTILPPSLIHDIRNEPGLSFIKAISETFHTHLPGFEPFATGNRADSLIQVTEPLSEETSFATELAFGKSAEWKEFVLKTKILDLVARLSSRVFLGPEVARNEDWLSITKSYTIHGFLAAEQLRNYSPWWRRLANQFLPECRLVRRQLVEARAIIGPVVQKRRDDRQQAVDRGLPPPAFNDALDWFEAESHGSAYDAAICQLSLSTAAIHTTTDLLTEVMFNIAKHPEIIADLRQEIVSVLAAEGWKKTALYNLKLLDSVVKESQRMRPVGLVSMMRTATRDVPLSNGMVLRKGQRTAVDMAQMRDPSVYDDPDTFDAYRFVRMRGTPGQENQAHFVSTGPASLGFGHGQHACPGRFFAANEVKVALCHLVMKYEWKLAPGCEPKAAEFGFSLAVDMNAKVLMRRRAPELDIDAL

SEQ ID NO: 1469 - protein, 531 aa, Glomerella graminicola
  misc_feature (1)..(531): Public GI ID no. 310791795
  misc_feature (1)..(531): Glomerella graminicola M1.001
  misc_feature (146)..(508): Pfam Name: p450 Pfam Description: Cytochrome P450
  misc_feature (1)..(531): Bit score of 677.2 for HMM based on sequences of Figure 6
  misc_feature (1)..(531): Functional Homolog Of SEQ ID NO. 1429
MATTNDSYSNQSSWGALESLQAFPSPLEKPVPYFITAFLLFVFYFSVQQSEQTPHTDLPILNPRHKWDFTWLKVKWDFVFHARRLVEERTKASPNEPYQLLTDTGDVTILPAVPFANEIRNHEDLSLDRNFHAYLPGFEPLKEANPQKEVLKHVIRTRLTQFLSKLTAPVSDETTRSLNDTFGEEEDWQTVAIKVKMLEVVARVSTRVFGGEKLCRNPAWLKITSEYARTSFLASEILRIFPKPLRSAIHYISPLSRNLQAQVKEAREIINPIVEERRREKKAALDRGEEEPEYNDCIEWCEESSDDAISDPAMMQLGLSFAALHSTSDLITQVMLDLARYPDYFEPLRKEITDVIRTDGWSRMGLYKMRLLDSFCKETQRLHPIGIVSMHREVTKTMTLSNGLELPEGSRIAVSCQRMHDPSVYLDPSRFDGHRYLRMRESLGAGNDGAAHFVSTSPEHLGFGHGQHACPGRFFAANEVKIILCHLLLKYDWRLAAEVQPKPINFGFALEVDPKASIEIRRRTGDLGLKA

SEQ ID NO: 1470 - protein, 534 aa, Gibberella zeae
  misc_feature (1)..(534): Public GI ID no. 46111581
  misc_feature (1)..(534): Gibberella zeae PH-1
  misc_feature (191)..(509): Pfam Name: p450 Pfam Description: Cytochrome P450
  misc_feature (1)..(534): Bit score of 586.7 for HMM based on sequences of Figure 6
  misc_feature (1)..(534): Functional Homolog Of SEQ ID NO. 1429
MICRALDASTVCSYKTQHSSSMATDLDLVLGKSQYALFCGITLFSFFILKYSLLGNGGKQYPYINPKKPFELSNQRVVQDFIENARDILTKGRSLYKDTPYKAHTDLGDVLVIPPEFADALKSERQLDFTEVARDDTHGYIPGFEPIGSPFDLVPLVNKYLTRALAKLTKPLWAEASLGVNHVLGTSTEWHPINPGEDIMRIVSRMSSRIFMGEELCKDDDWLKVSIEYTVQLFQTADELRNYPRWTRPYIHWFLPSCQGVRRKLQEARDLLQPHIDRRNAVKKEAIAEGRPSPFDDSIEWFENEYEGKSDPATEQIKLSLVAIHTTTDLLSETMFNIALQPELLGPLREEIVTVLSTEGLKKTSFYNLKLMDSVIKESQRLRPVLLGAFRRMALADVTLPNGDVIKKGTKIICDTTHQWNPEYYPDASKFNAYRFLQMRQTPGQDKRAHLVSTSHDQMGFGHGLHACPGRFFAANEIKIALCHMLLKYDWKLPEGVVPKSKALGMSLLGDREAKLMVKRRAAEIDIDAIGSDE

SEQ ID NO: 1471 - protein, 511 aa, Nectria haematococca
  misc_feature (1)..(511): Public GI ID no. 302912247
  misc_feature (1)..(511): Nectria haematococca mpVI 77-13-4
  misc_feature (228)..(492): Pfam Name: p450 Pfam Description: Cytochrome P450
  misc_feature (1)..(511): Bit score of 652.9 for HMM based on sequences of Figure 6
  misc_feature (1)..(511): Functional Homolog Of SEQ ID NO. 1429
MHSMLWAELLPRLDAIGKPLPLIVTIAVILFVYHAFQPFRSNVPILNGRKGLELTNQRPKKEYVSQATKLVGDWFNSNPNKPVRLISDVEEITVLPPSLAQEIRSDKRLSFSQWTFKLTSQKSFHGNLPGFDGFAAGTGGTNLVQTVVTKDLTKFLSAVPCTSGFSSLTEKWHDIPMRDKVLRLVARISSRVFLGPELCRNENWLRITRDYTVTGFFAGEDLRMWPEFVRPLVHWFLPGCRKLRADVKEARSMINSVVEERRKRNQELTAAGQDIPDYNDAIAWFDKAAKGATYDRAAMQLSLSLAAIHTTTDLLTQVLTRISQNLEILKPLREEMISVLREEGWNKTSLYKMKLLDSVIKESQRMKPTEIVSMMRLALDDVKLSDGTVIPKNTGVAVSSHRMWDPSLHPNPHQWDGTRFYKMRDDPAKQNSSQLVSTSPDYLAFGHGQNACPGRFFASNEVKIALIQIILKYDFELKEGASPQIYKHGFTLTGDPFLELRIRRRKEEVPL

SEQ ID NO: 1472 - protein, 499 aa, Nectria haematococca
  misc_feature (1)..(499): Public GI ID no. 302890983
  misc_feature (1)..(499): Nectria haematococca mpVI 77-13-4
  misc_feature (117)..(475): Pfam Name: p450 Pfam Description: Cytochrome P450
  misc_feature (1)..(499): Bit score of 547.0 for HMM based on sequences of Figure 6
  misc_feature (1)..(499): Functional Homolog Of SEQ ID NO. 1429
MLLSTMFDFFQRSPSGETNTLSLYLQTLLLGVGTPATRWFLEGYQMVLRGLKTVSGPFQVMTGTGPILVLPNNYANEVRNNPHLSFNRFFDKDFFVKYPGFEAYKTGYQDGTFIQEVVRTKLTQSLGLVTDDLVDEMTASAHDLIGEDKEFKAVTLKEVISLMVARLSSRVFLGKNLARNDRWLHIAMHYTHDSYSAAAELRQWPFFLRPFVYWFLPLCRKLRQEVKDADALIMPEVNRRKEAVLKAQASGEKPPRTSDTIGWMFEISRGRDVNYVYGQLFLSFAAIHTTTETITGCVLDISSYPEIVQPLREEIISVIGEHGWAKTSLYKLKLMDSFMKESQRRHYMGMTSIHRHADEDIKLSDGNVIRKGSRMCVTAEPFIDPKVYPEPEKYDVYRFLNLRSQPGQENAHQFVTTSPQHMLFGHGTHACPGRFFASNEMKIALCHLILKYDWKLCDGQTERPKNLQVDAGFLTDPTVKVMVRRREAEIDLDVGIAEE

SEQ ID NO: 1473 - protein, 449 aa, Ajellomyces capsulatus
  misc_feature (1)..(449): Public GI ID no. 325095532
  misc_feature (1)..(449): Ajellomyces capsulatus H88
  misc_feature (182)..(436): Pfam Name: p450 Pfam Description: Cytochrome P450
  misc_feature (1)..(449): Bit score of 560.4 for HMM based on sequences of Figure 6
  misc_feature (1)..(449): Functional Homolog Of SEQ ID NO. 1429
MPSTLGLAAIFILLPTLFFQLTLPKKSRLPLINGKKLSEFSYTHSGKRFLKNARILIDEGLGKAKAFRLLTDNGPKTVLSADYADEIRSHPLLNFGAAIAKEFHADIKGFDTFKQGTRADEIFQDAVRMQLTHHLGWHDIVLKKSALKIVAQLSSRVFLGEKLCRNPDWLRITISYTVNSYIAAQALRLWPEVIRPLVASFLPSCRKLRQEIEEARAIINPVLEERRQAKEAAIRVGKTPERYLDAMQWLEESARGRYYDPVVAQLSFSHAAIHTTSDLLTQVLFNLCGRDELTQKLRDEIITVTQAEGLKKTTLFKLKLMDSVLKETQRLKPVAVATMRRLAEEDIELSDKTFLPKGELIVVACDKMWDPDTYPNPSTFDPYRFVKLREKPGHEMSAQLVSTSPEHLGFGFGKHACPGRFFAANEIKIVLCHILLKGSHRKYLGEQRT

SEQ ID NO: 1474 - protein, 518 aa, Glomerella graminicola
  misc_feature (1)..(518): Public GI ID no. 310801736
  misc_feature (1)..(518): Glomerella graminicola M1.001
  misc_feature (149)..(481): Pfam Name: p450 Pfam Description: Cytochrome P450
  misc_feature (1)..(518): Bit score of 547.3 for HMM based on sequences of Figure 6
  misc_feature (1)..(518): Functional Homolog Of SEQ ID NO. 1429
MLLRNRWLHEYFYTPQAWYIITAFVVILLTRLLRRSSSVDDIPLINPKKGWEITKSGAQRRFLKNARAMMDKALSDFPERPFRVFCGFGEVIILPAERINEIRNDHRFKFSLGPGPTLQYPGFEAANRCLDDVGLFDVIKLDLTRHLGNMTEAITDATGDAIKKIFHDSTEWRDIRLKQDVLQLIGRVSSRQFVGEELHGTDEWLKVSLDYANNIFVAAFFLGLVPPLLRPIAHWFIPQCRALRVGMREARKLSREILAKRRNDNEELRARGEPQVVYNDIFGWSEIRSGSQPHYDPAASLMALSILALHTTADLLCRTLLDLAERPELVEELRQEMIKALSDKGWKMDALHEMRLLDSVIKESLRLDPGALTSLSRVLDEEVRLSDGTVLPKGSQTLIPSYRQWDPALYENPDVYDPYRFLRMRQEKGKEKSSLLVSTTENFTSFGHGVLACPGRFFAASEIKIALVHLLLGYDFRPASGYKRQNVCFDFVEQFDPDSRICMRRRQVPVDLHRFARS

SEQ ID NO: 1475 - protein, 507 aa, Aspergillus oryzae
  misc_feature (1)..(507): Public GI ID no. 169786189
  misc_feature (134)..(486): Pfam Name: p450 Pfam Description: Cytochrome P450
  misc_feature (1)..(507): Bit score of 641.3 for HMM based on sequences of Figure 6
  misc_feature (1)..(507): Functional Homolog Of SEQ ID NO. 1429
MLGDLFESVLTNNSVTLLITVAVAAIALHLSSPKSNLPLVNDKKPWEFRFTKARKRFLANAHNLIKAGLAKAPAFRIVTGNGKRVVLDAKYANELRSHDDLSFGLHIADNFHAHIRGFQPFKQGSNDDEIYQNAVRMKLTQSLGNLTQPLVDETLVALQTYWTNDTNWHAIPLKSNIQKVVAQLSSRIFLGDQICRNPNWLRIAVDYTVDAFKAAEELRLWPKAFRAIVALFLPSCRKIRAELQEAQDIIRPVLDARRKDKQAALSAGKEPERYNDAMQWLEECAKGRSYEPAFGQLTFSVAAIHTTSDMLTQVLYDLCGRDALIQALREEVITVVQEEGWTKPTLYKLKLMDSVLKESQRLKPISVVSMQRVATADLRLSDGTFIPKGTSLAVSSDRMWDSEIYPNPLEFDGYRFLKLRELPGHETSAQVVSPSPEHMGFGFGRHACSGRFFAINEVKIALCHILLKYEFKLADGSVPRATKFGFSFTSDPTTKLMIRRRQEETVL

SEQ ID NO: 1476 - protein, 528 aa, Metarhizium anisopliae
  misc_feature (1)..(528): Public GI ID no. 322704477
  misc_feature (1)..(528): Metarhizium anisopliae ARSEF 23
  misc_feature (235)..(499): Pfam Name: p450 Pfam Description: Cytochrome P450
  misc_feature (1)..(528): Bit score of 492.1 for HMM based on sequences of Figure 6
  misc_feature (1)..(528): Functional Homolog Of SEQ ID NO. 1429
MAFESLLGSIDPVPLSEPPSYHLHCARLWAFVLLALVALYLRMSRHAQQNADFTLANPPKWYELKVVKQIRFLFNGIGELDKAREKANGNPFRLLTNSREIIVLPPSYAEVLNAEDRLSFAKYFADEFDGDGKTPGLEPYTLIADPCKRVPKLVTKRLTRSLNTIPIKMSSEASFAIEYNFGGGVNWQEVAIHQHLLDVIARMISRLFWDGDEVCRDERWLQIMKEWSVNSVIAAFMINMAPSFARPLIRRFSPTVRRARDDYQAARRFIEPLINVRRQAREKARESGERALAFDDIVDWIDSENEELTCDPVALQMVLNVAAVHTTAALVTNTISFLASDPSTLEPLRQELVAELRSNGCQAAALNNLKLLDSAIKESLRLKPPGVFGMHRAALQDMQLPNGMRIHKGDRVFVDIPHMRDPNIYESPDTYDMYRFYRMRCQPDQALKAPLVHTSPEHLAFGHGAQACPGRFFAAILGKVVLSHLLLKYDWKLAPDSDLTSLAIGLTKRINPKLKLLFRRRNEEFELS

SEQ ID NO: 1477 - protein, 497 aa, Arthroderma otae
  misc_feature (1)..(497): Public GI ID no. 296809607
  misc_feature (1)..(497): Arthroderma otae CBS 113480
  misc_feature (119)..(471): Pfam Name: p450 Pfam Description: Cytochrome P450
  misc_feature (1)..(497): Bit score of 560.7 for HMM based on sequences of Figure 6
  misc_feature (1)..(497): Functional Homolog Of SEQ ID NO. 1429
MLDALIRAGNAYRVDVALSFVVLLVVSYIARVVSQRHRYSKFPLHSDKSNTKQMLLSGFAKYKNAFHINTAIGKDIILSADYANEIKSDPHLDFAKAILPTLLTHLSTFHHIEEAGKNQVLTETIRSKLSRLPVHLKQAISSEAREVIRDKLTDDEEWHEIPIKETIVKIVARVSSRVFLGEELCRNEEWLRITADYTINLFVAINELMTWPASIRPIVQWFLPTCRRLRQQVADARQLIQPVIDRRHAENHELRRQGKPVKQYDDAISWLDDKAGGRLFDAAIAQLSLSFVSIHTTTDLCTQAIYDICANPELIQPLREEIINVLGSRELDTTALYQMKLMDSVIKESQRLKPAGVLSMKRYATQDVTLSDGLVVPKGSSLSVSSHVHWEESVYPEPLKYDGYRFLRMKGDREKDRMANLVATSPEHLGFGHGIHACPGRFFAADEIKILLTHILLKYDFKLPEGSNTTPYILPGGSYVSASTQLTIKRRKEEITL

SEQ ID NO: 1478 - protein, 499 aa, Trichoderma virens
  misc_feature (1)..(499): Public GI ID no. 358384333
  misc_feature (1)..(499): Trichoderma virens Gv29-8
  misc_feature (284)..(470): Pfam Name: p450 Pfam Description: Cytochrome P450
  misc_feature (1)..(499): Bit score of 678.6 for HMM based on sequences of Figure 6
  misc_feature (1)..(499): Functional Homolog Of SEQ ID NO. 1429
MSWVHSNPILCLCLVILILAGIPVLLYFPTHRNLEHLPLLKPVDGFSLLDIKSKTAFVFRSKELLAKGRALFPQSPYRMITDLGEIVFLPVGLADEIRNDPRLSFGSAFGEGAAVHTYNDSVLQTIVRKELTKSIVINPMSVEATHSLSINLEWREIELKSVIVDVVARLSARVFLGKDLCRNEDWLRATKEYTINFFVAGTHLRMIPRPLRPLLHWFVPKCRELRASFNESRRIIMPAIHRRRVARAAALTAGEKIPEFDDAIDWADREAAARGVGYDPAIMQLMLAVAAIHTTTDLVTQFIIDLALNPEFVAPIRQEIVHVLRTTGMKKSALHDMKLLDSALKESQRHKPPGLASMRRRAEKPLTLSNGLALKVGDRIAIDTYRMNDPELHKEPEKWDPYRFLRISEQPEKSKFAQLVVTSPDHLAFGHGEHACPGRFFAAYEIKIILCHLLLKYEWELVPGSNIAPMVLGLTYAASPVARIKIHRRRELELDIDSL

SEQ ID NO: 1479 - protein, 529 aa, Colletotrichum higginsianum
  misc_feature (1)..(529): Public GI ID no. 380486688
  misc_feature (99)..(506): Pfam Name: p450 Pfam Description: Cytochrome P450
  misc_feature (1)..(529): Bit score of 705.4 for HMM based on sequences of Figure 6
  misc_feature (1)..(529): Functional Homolog Of SEQ ID NO. 1429
MDKSHPTRAPLGDTGFTLEAPANPIPYFFATLLAAFFIYSMQGSKINLPSANPKKFFELTNSRPKKYYLTNARSIMARWFSANPNKPMKMVSDMDESIVLPPSMANEIRSHKDLSFAEFSEVFFQTKYPGFEAFAVGNHSSPTLTVINKDLTKQLAKVTEPLADETSLALKHTFTENKSWHAIHMRATFLEVIARVSSRVFLGTELCRNEAWLDITKNYTLDGFAAGERLRDFSPFVRSFVHWFLPVCQSARKRVRESATIIQPIIDKRNALKAQAVAEGRPEPEYLDAIEWFEKAAQANGVTLDPSLCQLFLSTVAIHTTTDLMGQVLVDLAKNPGIIKDLQEEVLRTLKESGWKKNSLYNMKLLDSVIKESQRLKPLQLASMQRIATADVTLSDRTFIPKGACVSVSSHALWDPEVYPEPEKWDGYRFYRLREKAGKENFAQLVSTAPEHLGFGHGKHACPGRFFAANEIKIVLAHILLQYEWRLPVDAKADIFDYGNAAIMNPHLEIEIRRRADEVDLDKFLEQLV

SEQ ID NO: 1480 - protein, 518 aa, Colletotrichum higginsianum
  misc_feature (1)..(518): Public GI ID no. 380485723
  misc_feature (84)..(495): Pfam Name: p450 Pfam Description: Cytochrome P450
  misc_feature (1)..(518): Bit score of 604.0 for HMM based on sequences of Figure 6
  misc_feature (1)..(518): Functional Homolog Of SEQ ID NO. 1429
MASYAPLDPDFSPYTIPSPAEKPIPYLITAFLFVALVYAVGDHGSKLPEVNPLRAFEFTNRRRMNEFVQHSKDIMFKGKAAFAGSFYKMYSEWGEVVVLPPQFIHELRSEPALDFLEPATDDSHGYIPGFEPFNGNPAVAKVVTKYLTKALTKLTKPLSEEATLVIRHVLTDSTDWHQIVPQKDIIRIVSRLSSRVFMGEELCRDEEWVRVSGDYTAAAFSVANELNQWPRRVRPVVHWFLPSCWRVRGLLAECHESLKPHLEQRNARKMKAVARGETKAVFDDSIEWFDQESKTKHDPATDQISLSLVAIHTTSDLLQQTMLDLASHPELFQPLRVELVRVLSAEGLKKTALYNLKLMDSVIKESQRMKPVLLSTWRRLVKKDIELSNGFVLRRGQKVIATNTHMWDAEFYENPLTYDGYRFLNMRSTDEEKHAHLVSTSAKHPAFGHGAHACPGRFFAANEVKIALAHLLLKYEWKLPEGSNFKPMPYGMSFLPDPTATLLIRRRKEELDLESLDC

SEQ ID NO: 1481 - protein, 529 aa, Colletotrichum higginsianum
  misc_feature (1)..(529): Public GI ID no. 380493657
  misc_feature (149)..(522): Pfam Name: p450 Pfam Description: Cytochrome P450
  misc_feature (1)..(529): Bit score of 670.1 for HMM based on sequences of Figure 6
  misc_feature (1)..(529): Functional Homolog Of SEQ ID NO. 1429
MSTYGNASTFMSSFNEVSWLGDRTLDQLSSGHKLLGTILIVLTLTWIFSHLTTKTNDLPMVNAPRFWEPRLLVQLSFLFKARKLVAEGLKLQRAFRILTDIGVITVLPSEFADEIRSDSRLSYPQVITENFHARFPGFEGFREGTTDATLSRDIARKHLTQSLDKVTGALAEECTAALKDHFPDVQDWQEINLREHVLLLVARLSSRVFLGEEVTRDSAWIKITTEYTTDAYVAAKILRLWPASLRPVVHWFLPCCIKLRRHVAKARTIIVATIEQRRQAKEAAVKSGSPVPVFNDVIEWLEQDSNEKTSNYDPVVAQLILSQAAIHTTTDLLTQAILEIAANPDIIPPLREEVSQIVCKSGWSKASLYEMKLTDSVLKESQRRKPLAMTFMHRLVLEDVTLSNGDRIPSGSVIGVSADKLWDPVVHENPEKFDGYRFVRMRDSADSKQANQAHLVSTSPNHLAFGHGKHACAGRFFAAHESKMALANLLLRHDWKLAPISANEKPVEFGLVLVANPKARICIRRRQNP

SEQ ID NO: 1482 - protein, 513 aa, Glomerella graminicola
  misc_feature (1)..(513): Public GI ID no. 310801960
  misc_feature (1)..(513): Glomerella graminicola M1.001
  misc_feature (168)..(489): Pfam Name: p450 Pfam Description: Cytochrome P450
  misc_feature (1)..(513): Bit score of 527.0 for HMM based on sequences of Figure 6
  misc_feature (1)..(513): Functional Homolog Of SEQ ID NO. 1429
MLQISHNPLHPLAQYLPQWVSRSLSSILLVAAFSLIILTLLSLISTQRHLKDIPLINPPNSLFQTTAEIAKQYSTNPVTIIERGRNIYPDQPYRMITNQGTVVVMPPQHAEEIANKSELNLMARARTECHAGTPGFSGLTTGPDGDRLAIDVVKKPLTKSLEWHEVQLLPRMLDIIAQTSSRVFLGEELCRNEDWLRITKTYTSKAFVLAGKLGNIPRPFRPLLHWFIPGMKELRDLCAKAEAIIQPIYNARQKAKARALADGKAIPTYDDCIEWAEAEAHASYQPAMLQMNIAVAAFHNTAELLSRVVLNIAHHPHIIRELREEAIDVLKADGWRKTALSKMKKLDSVIKETLRLKPSGTLTMRREATSPTTLSTGLTLKTGDALIVDPFNSFRDPTLYENPEQFIPWRFLHWQNEPGKQHLAHLVSTSPAHLGFGHGIHACPGRFFAADEIKIVVCHMLIQYDWKPPPMSSWKPVHAGIFMVTPPDTVLLFRRRPHPEIDVKRLPPTLVRN

SEQ ID NO: 1483 - protein, 506 aa, Colletotrichum higginsianum
  misc_feature (1)..(506): Public GI ID no. 380493536
  misc_feature (42)..(479): Pfam Name: p450 Pfam Description: Cytochrome P450
  misc_feature (1)..(506): Bit score of 556.4 for HMM based on sequences of Figure 6
  misc_feature (1)..(506): Functional Homolog Of SEQ ID NO. 1429
MHNETRVDSYLNDLVGDRFVVCFTTLVVTLLLSRILAKPVINLPELNPKKPKEILIQGRERFHNKLYKAYCDWGEVIVVSPEHIEELRSDMRLSFMVPANDDTHGYIPGFDPFQLDERLAKLVTKHLTKALTKLTAPISKEAAFALRSILTDSSAWHEMNPKEDLVRLVSQMSTRIFLGEEFCRNEAWINASGDYTLAAFEATDPVRMWPRLLRPVVHWFMPICWDLRLKLADARQTLEPYMASRNAIKAAALAKGEPCPFDDLVEWWESEYGPSNNHVINQLTLTIVAIHTTSDLLQQTMIDIAKNPELFAPLREEVVQVLGSQGLKKTALYNLKLMDSVFKESQRLKPVLLGIWRRQALADVELSDGYVIKKGQKVIGDSTHMWSSDYYTDAQKFDGYRFMRLREATGGEDSDSKTAHLVSTSSKHLGFGHGLHSCPGRFFAANEVKIALCHLLLKYDWKLSEDAKPDSNWTVFGMTIIPDPSIKLMVRRRQEEIDIDSLESSE

SEQ ID NO: 1484 - protein, 547 aa, Colletotrichum higginsianum
  misc_feature (1)..(547): Public GI ID no. 380485117
  misc_feature (173)..(519): Pfam Name: p450 Pfam Description: Cytochrome P450
  misc_feature (1)..(547): Bit score of 675.5 for HMM based on sequences of Figure 6
  misc_feature (1)..(547): Functional Homolog Of SEQ ID NO. 1429
MATANNSYSNQSWGPLDTLQAIPSPLEKPVPYFITAFLLFVFYFSIQQTEQTPHTDLPILNPRHKWDFAWLKVKWDFIFKVRHVVEERTKTNPDEPYQVLTDAGDMTILPAVPFANEIRNHEDLSFDRVLDKASFPWDCTTYRARNFHAYLPGFEPLKEANSQKAVLKYVIRTRLTQFLSKLTAPVSDETTASLNDVIGEEKEWQTVVIKEEMLKVVARVSTRVFGGEKLSRNQEWLKITSEYARTSFLASELLRIFPKPLRSFVHQINPLSRKLQAQVKEAREIINPIVEERRVEKKAALDRGEEEPEYNDCLEWCEESCEDASSDPAMMQLGLSFAALHTTSDLITQVMLDLAKYPDYFEPLRKEVTDVIRTDGWSRMGLYKMRLLDSFCKETQRLHPLGIVAMHREVTKPVTLSNGLELPEGSRIAVSCHRMRDSSVYLDPNRFDGNRYLRMRESLGAGNDGAAHFVSTSPEHLGFGHGQHACPGRFFAANEVKIILCHLLLKYDWRLAAEARPNSVNFGFTIEVDPKAKIEIRRRTGDLGLKA

SEQ ID NO: 1485 - protein, 506 aa, Thielavia terrestris; identical to SEQ ID NO: 1371
  misc_feature (1)..(506): Public GI ID no. 367046496
  misc_feature (1)..(506): Thielavia terrestris NRRL 8126
  misc_feature (134)..(478): Pfam Name: p450 Pfam Description: Cytochrome P450
  misc_feature (1)..(506): Bit score of 680.4 for HMM based on sequences of Figure 6
  misc_feature (1)..(506): Functional Homolog Of SEQ ID NO. 1429

SEQ ID NO: 1486 - protein, 528 aa, Trichoderma virens
  misc_feature (1)..(528): Public GI ID no. 358378098
  misc_feature (1)..(528): Trichoderma virens Gv29-8
  misc_feature (157)..(504): Pfam Name: p450 Pfam Description: Cytochrome P450
  misc_feature (1)..(528): Bit score of 700.6 for HMM based on sequences of Figure 6
  misc_feature (1)..(528): Functional Homolog Of SEQ ID NO. 1429
MDTFNATPLAWPARLVEEPIQNDKLFVYLGSAAVIFLIYLYSGRKSTPLPLVNPSGRWELTRNRTNKEWLAKAKEIIMRGVESFPGKPFNMMAADVGMTTVVPPEFAHEIRNNPNLSFVEFMAHLFFSNLPGFEPTREGMFDNDIGIVVIQKYLTSLARMTEPLSQETEYALPDIYTENEEWHDVNLRNTNLALVARLSSRIFLGEELCRNEDWLRITVNYTVDLMKAAEQLRQVPGPLRRLVHWILPEAKKLRAEVKQAGDIIRPILEKRRKEKASHLAQGKEPVEYYDAIEWFEQIAEEKQRLYDPEIVQLFLSTVAIHTTSDLLTVTMFDIARNPEIIEPLCDEIRSVLQNGGWKKTSLHDMKLMDSVIKESLRLKPIGLVSMRRVATSPVTLSDGTYFSKGTKLAVSSHKMWDASVYPEPQKWDGHRFLNIRETPESANTSPVKGKETLLVSTSERHLGFGHGKHACPGRFFAASELKVALAHILMKYDFKVPEGVEVKHRITGASYYADPFATLSLRRRKDEW

SEQ ID NO: 1487 - protein, 542 aa, Fusarium sporotrichioides
  misc_feature (1)..(542): Public GI ID no. 328671361
  misc_feature (161)..(502): Pfam Name: p450 Pfam Description: Cytochrome P450
  misc_feature (1)..(542): Bit score of 607.7 for HMM based on sequences of Figure 6
  misc_feature (1)..(542): Functional Homolog Of SEQ ID NO. 1429
MSKVDKTGYAQWVYLLPERSSMMSLINSMEDFRFDMLIYFLCFVILGRAVQWFLRPKPNAPLLNPRRFFEFSDSRAVSEILYSTRQVLEDWFSKYPTKPMRIIADLGQITILPPSMADEIKNDPRLSFIKASTESAFHITIPGFEPFREGAKNEAALIKNVLHKHLNKTLNHITTPLAEETCLAVQEYFGSDQGWHRVPLRDTLVPLVTRISTRIFLGQDLCRNQEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLLCQALEDISSHPEIINPLQHEIRQVLKEEGWNTKALYKMKLLDSVLKESQRLKPVQHATMLRLALEDITLEDGTFIPKGHQISVSCHAMRDNEIYENASSWDGYRYYRQREQSANEHKAQLSSTSPDHMGFGYGIHVCPGRFFAANEVKVIMIYLLLQYEWRTPPGSEPKPLSWCTTWATDPTFELEVRRKGSDDIPVELSHNTLNRESEF

SEQ ID NO: 1488 - protein, 542 aa, Fusarium sporotrichioides
  misc_feature (1)..(542): Public GI ID no. 328671376
  misc_feature (165)..(502): Pfam Name: p450 Pfam Description: Cytochrome P450
  misc_feature (1)..(542): Bit score of 606.7 for HMM based on sequences of Figure 6
  misc_feature (1)..(542): Functional Homolog Of SEQ ID NO. 1429
MSKVDKTGYAQWVYLLPERSSMMTFIDSMEDFRFDMLIYFLCLIILGRAVQWFLRPKPNAPLLNPRRFFEFSDSRAVSEILYSTRQVLEDWFSKYPTKPMRIIADLGQITILPPSMADEIKNDPRLSFIKASTESAFHITIPGFEPFREGAKNEAALIKNVLHKHLNKTLNHITTPLAEETCLAVQEYFGGDQGWHRVPLRDTLVPLVTRISTRIFLGQDLCRNEEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLICQALEDISSHPEIINPLQHEIRQVLKEEGWNTKALYKMKLLDSVLKESQRLKPVQHATMLRLALEDITLEDGTFIPKGHQISVSCHAMRDNEIYENASSWDGYRYYRQREQSANEHKAQLSSTSPEHMGFGYGIHVCPGRFFAANEVKVIMIYLLLQYEWRTPPGSEPKPLSWCTTWATDPTFELEVRRKGSDDIPVELSHNTLNRDSEF

SEQ ID NO: 1489 - protein, 542 aa, Fusarium sporotrichioides
  misc_feature (1)..(542): Public GI ID no. 328671358
  misc_feature (162)..(502): Pfam Name: p450 Pfam Description: Cytochrome P450
  misc_feature (1)..(542): Bit score of 607.2 for HMM based on sequences of Figure 6
  misc_feature (1)..(542): Functional Homolog Of SEQ ID NO. 1429
MSKVDKTSYAQWVYLLPERSSMMSFIDTMEDFRFDMLIYFLCFIILGRAVQWFLRPKPNAPLLNPRRFFEFSDSRAVSEILYSTRQVLEDWFSKYPTKPMRLIADLGQITILPPSMADEIKNDPRLSFIKASTESAFHITIPGFEPFREGAKNEAALIKNVLHKHLNKTLNHITTPLAEETCLAVQEYFGSDQGWHKVPLRDTLVPLVTRISTRIFLGQDLCRNQEWLRIAASYSSTSAEVANHLRRWPKPFRYLVSLLSPECQNLAKQVRNARALINPILERRRVEEGQEKGTSYNDSLEWFERYAREAYDPAATQLFLSVVSIHTTTDLLCQALEDISSHPEIINPLQHEIRQVLKEEGWNTKALYKMKLLDSVLKESQRLKPVQHATMLRLALEDITLEDGTFIPKGHQISVSCHAMRDNEIYENASSWDGYRYYRQREQSANEHKAQLSSTSPDHMGFGYGIHVCPGRFFAANEVKVIMIYLLLQYEWRTPPGSEPKPLSWCTTWATDPTFELEVRRKGSDDIPVELSHNTLNRESEF

SEQ ID NO: 1490 - protein, 542 aa, Fusarium sporotrichioides
  misc_feature (1)..(542): Public GI ID no. 328671355
  misc_feature (162)..(502): Pfam Name: p450 Pfam Description: Cytochrome P450
  misc_feature (1)..(542): Bit score of 607.3 for HMM based on sequences of Figure 6
  misc_feature (1)..(542): Functional Homolog Of SEQ ID NO. 1429
MSKVDKTGYAQWVYLLPERSSMMSFIDSMEDFRFDMLIYFLCFIILGRAVQWFLRPKPNAPLLNPRRFFEFSDSRAVSEILYSTRQVLEDWFSKYPTKPMRLIADLGQITILPPSMADEIKNDPRLSFIKASTESAFHITIPGFEPFREGAKNEAALIKNVLHKHLNKTLNHITTPLAEETCLAVQEYFGSDQGWHKVPLRDTLVPLVTRISTRIFLGQDLCRNQEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLLCQALEDISSHPEIIKPLQHEIRQVLKEEGWNTKALYKMKLLDSVLKESQRLKPVQHATMLRLALEDITLEDGTFIPKGHQISVSCHAMRDNEIYENASSWDGYRYYRQREQSANEHKAQLSSTSPEHMGFGYGIHVCPGRFFAANEVKVIMIYLLLQYEWRTPPGSQPKPLSWCTTWATDPTFELEVRRKGSDDIPVELSHNDLNRESEF

SEQ ID NO: 1491 - protein, 510 aa, Fusarium oxysporum
  misc_feature (1)..(510): Public GI ID no. 342883913
  misc_feature (1)..(510): Fusarium oxysporum Fo5176
  misc_feature (149)..(481): Pfam Name: p450 Pfam Description: Cytochrome P450
  misc_feature (1)..(510): Bit score of 563.9 for HMM based on sequences of Figure 6
  misc_feature (1)..(510): Functional Homolog Of SEQ ID NO. 1429
MTAYIDTILQNPQYAVLSAISVVTLLVVNFSFFTQQEKYPILIPKKPFELTNTRVVKEFIANSRSLLANARTVYKDQPYRAYTELGKVLVIPPSWVDALKSNRHLDFQTPARDDSHEYIPGFQPFGGSHKLTTVINKYITKALMKLTGPISEEASLSIRDTLTDSREWHPIRPQADLIRVVSRVSSRIFMGEELCRDEEWNRTSSEYTLLAFGYGGLLRSYPRWLRPYIHWFLPQCWEVRAKLNEARQCLKPHIERRKVIKQKALAEGKPSPFDDSIEWFEKEYEKHDPATEQIAVSIVAYHTTSDLLAETLLNLCQHPELFQELREEIIAVLTAEGGLTKGALYNLKLMDSVVKESQRLRPILLGAFRRIATADVTLPNGDILKKGDKIIGGMSHMWDSDTYDNALEFDPYRFVKMRQTGDDKKAHLVSTSADHLGFGHGFHACPGRFFAANEIKIVLCHMLLKYDWKLPEGCKPQPSHSGFKLLGDYSSNLLVRRRTEELDIDSLSSS

SEQ ID NO: 1492 - protein, 542 aa, Fusarium langsethiae
  misc_feature (1)..(542): Public GI ID no. 328671364
  misc_feature (161)..(502): Pfam Name: p450 Pfam Description: Cytochrome P450
  misc_feature (1)..(542): Bit score of 602.7 for HMM based on sequences of Figure 6
  misc_feature (1)..(542): Functional Homolog Of SEQ ID NO. 1429
MSKVDKTGYAQSVYPLPERSSMMSFIDSMEDFRFDMLIYFLGFVILGRAVQWFLRPKPNAPLLNPRRFFEFSDSRAVSEILYSTRQVLEDWFSKYPTKPMRLIADLGQITILPPSMADEIKNDPRLSFIKASTESAFHITIPGFEPFREGAKNEAALIKNVLHKHLNKTLNHITTPLAEETCLAVQEYFGSDQGWHRVPLRDTLVPLVTRISTRIFLGQDLCRNQEWLRIAASYSSTSAEVANHLRRWPKPLRYIVSLLSPECQNLAKQVRNARALINPILERRRVEEGQEKGTSYNDSLEWFERYAREAYDPAATQLFLSVVSIHTTTDLLCQALEDISSHPEIIKPLQHEIREVLKQEGWNTKALYKMKLLDSVLKESQRLKPVQHATMLRLALEDITLEDGTFIPKGHQISVSCHAMRDNEIYENASSWDGYRFYRQRELSANEHKAQLSSTSPEHMGFGYGLHVCPGRFFAANEVKVIMMYLLLQYDWRTPPGSQPKPLSWCTTWATDPTFELEVRRKGSDDIPVELSHNTLSRESES

SEQ ID NO: 1493 - protein, 542 aa, Fusarium sporotrichioides
  misc_feature (1)..(542): Public GI ID no. 27368044
  misc_feature (164)..(502): Pfam Name: p450 Pfam Description: Cytochrome P450
  misc_feature (1)..(542): Bit score of 606.0 for HMM based on sequences of Figure 6
  misc_feature (1)..(542): Functional Homolog Of SEQ ID NO. 1429
MSKVDKTGYAQWVYLLPERSSMMSFIDSMEDFRFDMLIYFLCFVVLGRAVQWFLRPKPNAPLLNPRRFFEFSDSRAVSEILYSTRQVLEDWFSKYPTKPMRIIADLGQITILPPSMADEIKNDPRLSFIKASTESAFHITIPGFEPFREGAKNEAGLIKNVLHKHLNKTLNHITTPLAEETCLAVQEYFGSDQGWHKVPLRDTLVPLVTRISTRIFLGQDLCRNQEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLLCQALEDISSHPEIIKPLQHEIREVLKQEGWNTKALYKMKLLDSVLKESQRLKPVQHATMLRLALEDITLEDGTFIPKGHQISVSCHAMRDNEIYENASSWDGYRYYRQREQSANEHKAQLSSTSPEHMGFGYGIHVCPGRFFAANEVKVIMIYLLLQYEWRTPPGSQPKPLSWCTTWATDPTFELEVRRKGSDDIPVELSHNTFSRESES

SEQ ID NO: 1494 - protein, 495 aa, Talaromyces stipitatus
  misc_feature (1)..(495): Public GI ID no. 242800740
  misc_feature (1)..(495): Talaromyces stipitatus ATCC 10500
  misc_feature (285)..(473): Pfam Name: p450 Pfam Description: Cytochrome P450
  misc_feature (1)..(495): Bit score of 656.1 for HMM based on sequences of Figure 6
  misc_feature (1)..(495): Functional Homolog Of SEQ ID NO. 1429
MPSAGLPIDVSWWDAVSTFGSAQAHLPYLAAVLLALMVLSSLGNSSKNAVMLNPKSVWELTSTRAKKEYIAGALQMMGNWFNANPNPHNPAQMIADTGVVTVLPSHMADEIRNDDRLSFSRWTLQAFHRNLPGFDGFREGGSDSGIIKAVIVKDLTKHLNKVTEPLAAETAMVIPELLSDNEEWHSIALKDTIVKIIARVSSRVFLGDLLCRNEEWLEVTRDYTLYSFTAAEELRLWPAPLLPIVHWFLPQCRKLRALLKVIDDAIEWFEKEANGQDYDPVSAQLILSVAAIHTTTDLTCQTLTQLAQNPEILAPLRKELVDVLQEHGWKKTSLYNMKLLDSVVKESQRLKPTGIATMRRLALDEVKLSDDTVIPKNSQICVSSLKLWDSEVYENPDKFDGYRFYKMREQAEGQTKAQLVTTAPEYLAWGHGKHACPGRFFAANEVKIVLIYLLLRYDWRIADGQTPQFRRNGFSLNLDQHLRMMIRRRQEEMVI

SEQ ID NO: 1495 - protein, 542 aa, Fusarium sporotrichioides
  misc_feature (1)..(542): Public GI ID no. 15054396
  misc_feature (192)..(502): Pfam Name: p450 Pfam Description: Cytochrome P450
  misc_feature (1)..(542): Bit score of 598.9 for HMM based on sequences of Figure 6
  misc_feature (1)..(542): Functional Homolog Of SEQ ID NO. 1429
MSKVDKTGYAQWVYLLPERSSMMSFIDSMEDFRFDMLIYFLCFVVLGRAVQWFLRPKPNAPLLNPRRFFEFSDSRAVSEILYSTRQVLEDWFSKYPTKPMRIIADLGQITILPPSMADEIKNDPRLSFIKASTESAFHITIPGFEPFREGAKNEAGLIKNVLHKHLNKTLNHITTPLAEETCLAGQEYFGSDQGWHKVPLRDTLGPLVTRISTRIFLGQDLCRNQEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLLCQALEDISSHPEIIKPLQHEIREVLKQEGWNTKALYKMKLLDSVLKESQRLKPVQHATMLRLALEDITLEDGTFIPKGHQISVSCHAMRDNEIYENASSWDGYRYYRQREQSANEHKAQLSSTSPEHMGFGYGIHVCPGRFFAANEVKVIMIYLLLQYEWRTPPGSQPKPLSWCTTWATDPTFELEVRRKGSDDIPVELSHNTFSRESES

SEQ ID NO: 1496 - protein, 532 aa, Magnaporthe oryzae
  misc_feature (1)..(532): Public GI ID no. 351648133
  misc_feature (1)..(532): Magnaporthe oryzae 70-15
  misc_feature (149)..(505): Pfam Name: p450 Pfam Description: Cytochrome P450
  misc_feature (1)..(532): Bit score of 520.2 for HMM based on sequences of Figure 6
  misc_feature (1)..(532): Functional Homolog Of SEQ ID NO. 1429
MSILPPVLAVATGWTKMSPLGSFALYFAAVSALLGLAAYVIRIGDHVRRMPPFINPPKPYDLTYSRSKMQAVAGTEGLMSKARERFGDKPYSIVTLGGPVMVLPVRFADEIRSDARLSFTKSAEQDFHAHLPAFRPFKGDITELLAAVAKTHLTKLIAKTTRPLCDEASRTLKMRIGDVSDWQHLGLEDLTLDMASRMAARVTSGEELCRNETWLRNTIQYTIHAAVAAAKLRLFPAPLRYLAHLVLPESRAMRAELARARELVAGVVDKRRRQRLHAAEAGLSAPRYEDAIEWGAAAAAEQSRASGGGGHYDPALFQLQTSVVGLHSTTDLLTQTLINILIHPDVVPPLRREIVSALGTEGWSKPCLHKLQLLDGVMKETQRLKPLELITMHRIATADVRLSDGSLIPKHTHSVVANTTRLDPSVYENPGDFDPFRWMRMGDSDETKHQAPMVSAGVNSLGFGYGLHVCPGRFFATDLVKMALCHLLIKYDMELDQESRPRPYVPMGFFLGHDQQVKIRIRRRAEEIDLDI

SEQ ID NO: 1497 - protein, 536 aa, Fusarium sporotrichioides
  misc_feature (1)..(536): Public GI ID no. 28975428
  misc_feature (164)..(496): Pfam Name: p450 Pfam Description: Cytochrome P450
  misc_feature (1)..(536): Bit score of 586.9 for HMM based on sequences of Figure 6
  misc_feature (1)..(536): Functional Homolog Of SEQ ID NO. 1429
MSKVDKTGYAQWVYLLPERSSMMSFIDSMEDFRFDMLIYFLCFVVLGRAVQWFLRPKPNAPLLNPRRFFEFSDSRAVSEILYSTRQVLEDWFSKYPTKPMRIIADLGQITILPPSMADEIKNDPRLSFIKASTESAFHITIPGFEPFREGAKNEAGLIKNVLHKHLNKTLNHITTPLAEETCLAVQEYFGSDQGWHKVPLRDTLVPLVTRISTRIFLGQDLCRNQEWLRIAASYSSTSAEVANHLRRWPKPLRYLVSLLSPECQNLAKQVRNARALINPILERRRVEEGQEKGTSYNDSLEWFERYAREAYDPAATQLFLSVVSIHTTTDLLCQALEDISSHPEIIKPLQHEIREVLKQEGWNTKALYKMKLLDSVLKESQRLKPVQHALEDITLEDGTFIPKGHQISVSCHAMRDNEIYENASSWDGYRYYRQREQSANEHKAQLSSTSPEHMGFGYGIHVCPGRFFAANEVKVIMIYLLLQYEWRTPPGSQPKPLSWCTTWATDPTFELEVRRKGSDDIPVELSHNTFSRESES

SEQ ID NO: 1498 - protein, 514 aa, Colletotrichum higginsianum
  misc_feature (1)..(514): Public GI ID no. 380471186
  misc_feature (77)..(482): Pfam Name: p450 Pfam Description: Cytochrome P450
  misc_feature (1)..(514): Bit score of 577.4 for HMM based on sequences of Figure 6
  misc_feature (1)..(514): Functional Homolog Of SEQ ID NO. 1429
MPPYGYVVVTILFVVSWKAFAPRNRDTSKASLRRLPILDQGKWWDLFNLKPIFNFYLDGRRALNQAIDQADGKPFRILGPGRELVVLPPDYAEEIRNDKRLDFSKVVAQFISHDLPGFEGFASGLKDLPVVLDMCKYKLTRDLASVIEPLPHECNLALEEILEIPHDWQRVAIKKRLNLVVARLSARVFLGEELCRNAAWLNIAVSHIMTGFMAALSLRMFPAFARPFVHWFLPHCRKLRFQVQQARDLIRPVILRRQQDKAAAVERGESPVEFNDGIEWSDLYANDRSFDRVDLQLGLSIAAVHNTTDLLSQVVYDLASDPDMVERLRNEASEVIGAMGWSKTSLYNLKLLDSVIKESMRIKPILTVAMPRQVTSQMTLEDGLVLPEGTVIGVSAQRHWDADVYAEPHRFIGDRFLKMRQLPGKENAAQLVTTGPNHLGFGHGNHGCPGRFLAAAELKIILAQLVLGYEWRVIRGLEPKIKVIGVNLDSDPAAVIEIRRRQIQSQLGIKADSS

SEQ ID NO: 1499 - protein, 515 aa, Gibberella pulicaris
  misc_feature (1)..(515): Public GI ID no. 270160636
  misc_feature (294)..(485): Pfam Name: p450 Pfam Description: Cytochrome P450
  misc_feature (1)..(515): Bit score of 592.2 for HMM based on sequences of Figure 6
  misc_feature (1)..(515): Functional Homolog Of SEQ ID NO. 1429
MMSLIDGMSDLRFDMLAYFLCFVISTLVVRRILRPKPNAPLLNPRRFFELSDSRAVSEILYTTRQVLENWFAKNPAKPMRLTCDLGQITFLPPSMADEIKNDPRLSFIKASNDSAFHISIPGFEPFREGGKNEAALIKDVLHKHLNKTLNHITLPVAEETYLAVKEYFGSDQNWHRVPLRDTLLPLVTRISTRVFLGQDLCRNQDWLRIATSYSSTAAEAANHLRRWPRLLRYQVSLLSPECRNLRKQVIDARALINPILERRQVEKGQEKGTSYNDSLEWFERHAGAAYDPAATQLFLSVVSIHTTTDLLCQALEDIFSHPEIVDPLKDEIRAVLKQEGWTTKALYKMKLLDSVLKESQRLKPVQRYNSASMLRLALEDITLKDGTFIPKGHQLSVSCHSMRDNEIYENASSWDGYRFYRQREQSAGQHKAQLSSTSPEHMAFGYGVHACPGRFFAANEVKIIMIYLLLQYEWKVPPGSKPNPPSWCTTWATDPTFVLEVRRKCTDDTALELPI

SEQ ID NO: 1500 - protein, 497 aa, Trichophyton equinum
  misc_feature (1)..(497): Public GI ID no. 326482954
  misc_feature (1)..(497): Trichophyton equinum CBS 127.97
  misc_feature (139)..(474): Pfam Name: p450 Pfam Description: Cytochrome P450
  misc_feature (1)..(497): Bit score of 561.8 for HMM based on sequences of Figure 6
  misc_feature (1)..(497): Functional Homolog Of SEQ ID NO. 1429
MLEALIQSGSAYRVDLALSCVVLLVVSYIARLVSHRQRYSKFPLHIDKSNPKQMLLSGFAKYKNAFHINTAIGKDIILSADYANELKSDPHLDFAKAILPTLLTHLSTFHHIEEAGKNQVLTETIRSKLSRLPVHLKQAVSREATETICDKFTDDEEWHEIPIKETIMKIVARMSSRVFLGEELCRNEEWLRITAEYTVNLFIAVNELMTWPTYVRPIVQWFLPPCQRLRQQVADARRLIQPVIDARHAENEELRRQGKPLKKHEDAIAWLDEKSGGRSFDAAIAQLSLSFVSIHTTTDLCTQALYDICANPELIQPLREEIIGILGSRELDTTALYQMKLLDSVIKESQRLKPAGLLSMKRYVKENITLSDGLVVPKGTSISVSSHVHWNESVYPEPNKFDGYRFLKMKGDREKDRMANLVATSPEHLGFGHGIHACPGRFFAADEIKILLCHILLKYDFRLTEKSNTTPYMMPGGAYMANSTQIDIRRRKEEITI

SEQ ID NO: 1501 - protein, 489 aa, Aspergillus terreus
  misc_feature (1)..(489): Public GI ID no. 115385677
  misc_feature (1)..(489): Aspergillus terreus NIH2624
  misc_feature (190)..(467): Pfam Name: p450 Pfam Description: Cytochrome P450
  misc_feature (1)..(489): Bit score of 516.8 for HMM based on sequences of Figure 6
  misc_feature (1)..(489): Functional Homolog Of SEQ ID NO. 1429
MLEPVSTAQSLWSFGLWILVILSPVLFFASRELGILNAKKRFAKNGFEEVLAGLRKSDVFGLMTINGPKIVLAPKFAQEIRSNPALSVSAFSSSELHAHIRGFDVFRQGEADDILQDTVRSKITQSIGDLIQPLSEECSLTLKPKWTDSPEWHEVCPHTTILDIIARLSSRAFIGDELCRNPKWLRLTVDFTVDSFRAAEALNWWPYALRPLVARFLPSCLKLHKYIQDADNMMKPVLESRRQAQAKDPQKSYPDTIQWFEETAQGRPYDPVRLQLTLAFASIHTTADLVIQTILDLCSAKNWDELCRSLREEIISSFREEGWRKPLLAKLKIMDSALKESQRLKPVSIVGMGRIAKEAVKLSNNTIIPKGTRLLVSNTAMWDPEIYPDPRTYDPYRFLRLREASENESAGQLVSLSPTHLSFGLGKHACPGRFFAAAEVKIILCHILLKYDIKLADGCKPKPLRAGTNLVADPTAKLLVRRRQEEVAL

SEQ ID NO: 1502 - protein, 559 aa, Magnaporthe oryzae
  misc_feature (1)..(559): Public GI ID no. 351649667
  misc_feature (1)..(559): Magnaporthe oryzae 70-15
  misc_feature (143)..(529): Pfam Name: p450 Pfam Description: Cytochrome P450
  misc_feature (1)..(559): Bit score of 499.7 for HMM based on sequences of Figure 6
  misc_feature (1)..(559): Functional Homolog Of SEQ ID NO. 1429
MSIPLGILYIVCIYCHKVHLSTQVGTQVGTSVHKTQLPKMSTLELFSNITSPVSDDLRDGTAFKYAPYLVTAIFVLAIVYSKRESYPDLPRLNPKGPLEFGWAKRLNHFMVHSPELLAEASRRFGDNPFKLFTDLGDIVVVPAKYANELKNHRGMNFMEVGVDSVHTYLPGFEPFAATPALVKVVNNNLTKTLAKLTAPMVQEAALGSSDIFGESKEWHEVSIEQIMGFILRISSRIFIGQELCRSKQWLEASRAWTHVAFQAVFTLRAYPRFWRPWIHWSIPCVNDSRRKLKLCREVLQPYIDKRNIVKAEAIARGEPSPFDDSIEWFEQENKTDFDPAQKQLQLIVAAVHTTTDLLVVALVNIAKNPEIIGPLREEIISSLSEEGLKISAFEKLKLMDAVFKESQRLKPIATIAFRRKAMEDVVLSDGFKIKKGTIIGIDGIKALRDERVYPDPLRWDPYRYIKLREAGEAAKARLVSVTQEHFGFGHGFHACPGRFFAANELKIALARIILNYDITVPEDVKNLPEAFSGSNYKIPKGTRFLFKRRKEELDLSTLV

SEQ ID NO: 1503 - protein, 513 aa, Aspergillus kawachii
  misc_feature (1)..(513): Public GI ID no. 358369247
  misc_feature (1)..(513): Aspergillus kawachii IFO 4308
  misc_feature (143)..(494): Pfam Name: p450 Pfam Description: Cytochrome P450
  misc_feature (1)..(513): Bit score of 555.6 for HMM based on sequences of Figure 6
  misc_feature (1)..(513): Functional Homolog Of SEQ ID NO. 1429
MELSVNAKEHGNPLGLGTLMCLLSLMLIFLLQWRDTSVSQNGLPLINARRRFEFIDLLAKKRFITNAQDLLKAGLKKASAFNIVTENGVMMVLDPKYADEIRNSKTLSLRKTLIEDMHVNVPGFEQQMQALEDDEIFQTTLKTKLTRNLEDLNEILSQEATVALQEHWTDDSEWHEIPLSRTMLKIIAQISSRVFLGDKICHNPKWLRISVDYSIDLFQATFELRIYPRFLRPLASKFQPSCRRLRADIREARSIIEPVIEERRKAKAIAKLEGRDPERHEDTIEWLEDVANGRQYNPVSAQLLLSSAAVHTSSDMLTQVLYDLDGREELIEAMRDEIKSVFNNGWERSSLAKLRLMDSVLKESQRLKPISSVSMRRMAEAPVTLSDGTIIPKDCKIIVPCLRQWEEKYYPEPETFIPDRFLKLRNEPGHEHTAAFANSSPNHLGFGLGRHACPGRFFAANEIKLALCHILLKYDFKVVGKKPETIVFGTMLAADPNGVIAVRRRQSKEQVRL

SEQ ID NO: 1504 - protein, 689 aa, Magnaporthe oryzae
  misc_feature (1)..(689): Public GI ID no. 39969835
  misc_feature (1)..(689): Magnaporthe oryzae 70-15
  misc_feature (104)..(490): Pfam Name: p450 Pfam Description: Cytochrome P450
  misc_feature (1)..(689): Bit score of 498.4 for HMM based on sequences of Figure 6
  misc_feature (1)..(689): Functional Homolog Of SEQ ID NO. 1429
MSTLELFSNITSPVSDDLRDGTAFKYAPYLVTAIFVLAIVYSKRESYPDLPRLNPKGPLEFGWAKRLNHFMVHSPELLAEASRRFGDNPFKLFTDLGDIVVVPAKYANELKNHRGMNFMEVGVDSVHTYLPGFEPFAATPALVKVVNNNLTKTLAKLTAPMVQEAALGSSDIFGESKEWHEVSIEQIMGFILRISSRIFIGQELCRSKQWLEASRAWTHVAFQAVFTLRAYPRFWRPWIHWSIPCVNDSRRKLKLCREVLQPYIDKRNIVKAEAIARGEPSPFDDSIEWFEQENKTDFDPAQKQLQLIVAAVHTTTDLLVVALVNIAKNPEIIGPLREEIISSLSEEGLKISAFEKLKLMDAVFKESQRLKPIATIAFRRKAMEDVVLSDGFKIKKGTIIGIDGIKALRDERVYPDPLRWDPYRYIKLREAGEAAKARLVSVTQEHFGFGHGFHACPGRFFAANELKIALARIILNYDITVPEDVKNLPEAFSGSNYKIPKGTRFLFKRRKEELDLSTLVLFDQYQKRKSNGKRFRVANNLILRPFPTSLGEQRSASISKTAKKPNLRRLSVLSSSINNLSAVVYRIAACSRWLRKPVMSRLRSLSLLARLLTGDHIADSSSRTKKVSQCRHLKPKIFGRDMLEGLGMRVKIGAAVLGVGARVDELDDFAEYIAINSRKVEGLSICLLK

SEQ ID NO: 1505 - protein, 496 aa, Trichophyton rubrum
  misc_feature (1)..(496): Public GI ID no. 327309580
  misc_feature (1)..(496): Trichophyton rubrum CBS 118892
  misc_feature (119)..(472): Pfam Name: p450 Pfam Description: Cytochrome P450
  misc_feature (1)..(496): Bit score of 557.9 for HMM based on sequences of Figure 6
  misc_feature (1)..(496): Functional Homolog Of SEQ ID NO. 1429
MLEALIQSGSAYWVDLALSFVVLLVVSYVARLVSHRQRYSKFPLHIDKSNPKQMLLSGFAKYKNAFHINTAIGKDIILSADYANELKSDPHLDFAKAILPTLLTHLSTFHHIEEAGKNQVLTETIRSKLSRLPVHLKQAVSREATETIRDKFTDNEEWHEIPIKDTIVKIVARMSSRVFLGEELCRNEEWLRITAEYTINLFIAVNELMTWPTYVRPIVQWFLPPCQRLRQQVADARRLIQPVIDARHAENYELRRQGKPPRQHEDAIAWLDEKSGGRSFDAAIAQLSLSFVSIHTTTDLCTQALYDICANPELIQPLREEIISVLGSRELDTTALYQMKLLDSVIKESQRLKPAGLLSMKRYVKESITLSDGLVVPKGTSISVSSHVHWDESVYPEPNKFDGYRFLKMKGDREKDRIANLVATSPEHLGFGHGVHACPGRFFAADEIKILCHILLKYDFRLTEKSNTTPYMMPGGAYMANSTQIEIRRRKEEITL

SEQ ID NO: 1506 - protein, 499 aa, Phaeosphaeria nodorum
  misc_feature (1)..(499): Public GI ID no. 169612674
  misc_feature (1)..(499): Phaeosphaeria nodorum SN15
  misc_feature (196)..(480): Pfam Name: p450 Pfam Description: Cytochrome P450
  misc_feature (1)..(499): Bit score of 493.9 for HMM based on sequences of Figure 6
  misc_feature (1)..(499): Functional Homolog Of SEQ ID NO. 1429
MSDPRSSHAPGYLKDASLDLTARFLPAIATVALVVVSAIAYTIFNNNSKYPLANPPGWFQTKLSKRIEFLKDGNRILGEARKRYGGRPYRLITDWGDNLILPADRVTSIHLEKKLALSPAVHDDFHADVAGFSPYGLAWIGQNIARKHLTKSIKWTESIVMKDVLSLISRISSRVFLGEELCRNEAWLRVTRDWTVQSFEAANLMTVCPGAFKFLMPRFSKKCKNVLAIYNEARGILEPVIERRRQLKAEAKRKGTPIPIFSDAIEWAEIESRGNPYSAVDCQLNLSFAAIHTSSGLLSQVLTRLSNEPHLITPLRHEIIEVLTAEGMNKNSLYNLKLMDSALKETQRIKPDQMLNLRRMATDNVVTSDGLEIKKGQRVVVDLGNMVDSKSYSEPEKFDIYRYYNWRQDPATAVKSQLVATSADNLTFGHGNHACPGRFFAANELKLALCHLLLKYDWELSPDASLEALHPAAVMSILNPSNKIRFRRRKAELDIDGLV

SEQ ID NO: 1507 - protein, 508 aa, Fusarium
  misc_feature (1)..(508): Public GI ID no. 269856265
  misc_feature (1)..(508): Fusarium sp. NRRL 13405
  misc_feature (145)..(480): Pfam Name: p450 Pfam Description: Cytochrome P450
  misc_feature (1)..(508): Bit score of 561.9 for HMM based on sequences of Figure 6
  misc_feature (1)..(508): Functional Homolog Of SEQ ID NO. 1429
MLNLIKDMPISAYPLSFLFVALTLAVRRLLAPKPSAPLLNPRRFYEFSDNGPVTRILNTTRRTIEEWFSKNPETPMRLICDLGEITVLPPSMADEIKKDSRLSFIKASNDSAFHISIPGFEPYREGGKHEAALVKNVVHGHLKKTLNRITLPMAQETYLAIDEYLGSSQEWHKIPLNVTMLPLITRISTRVLLGEDLCRNEEWIRIASSYSVTSTTVAGRLRRWPQHLRYIVSLLSPQCWELRKQVSDSHALIDPILEKRRSEEKGTVYNDSLEWFEKTAKAAYDPADTQLFLTAVSIHTTVDLLSQALEDICAHPEIIGPLQDEIRSVIKEEGWNTKALYKMKLLDSALKETQRLKPVQIASMMREALVDVTLQDGTFIPKGHQLAVSCHNMRDEKIYPNADEWDGYRFYRERQEADAAREDKIQLSSTSVEHMGFGYGEHACPGRFFAAKEVKIVMMYLLLNYEWRIPEGTKPNPVSCCTIWVTDPTFEIEVRKKPSEDPALELAY

SEQ ID NO: 1508 - protein, 542 aa, Fusarium incarnatum
  misc_feature (1)..(542): Public GI ID no. 269978413
  misc_feature (216)..(514): Pfam Name: p450 Pfam Description: Cytochrome P450
  misc_feature (1)..(542): Bit score of 564.3 for HMM based on sequences of Figure 6
  misc_feature (1)..(542): Functional Homolog Of SEQ ID NO. 1429
MSFIKVELLLQVNVIESQGKEWSRRASVSIDHPRMLNLINSVPTSAYPLFFLFVILTLVVRRLLAPKPSAPLLNPRRFYEFSDNGPVSRILNTTRKTIEDWFAKNPETPMRLICDLGEITVLPPSMADEIKKDSRLSFIKASNDSAFHISIPGFEPYREGGKHEAALVKNVVHGHLKKTLNRITLPLAQETYLAIDEYLGSSQEWHKIPLNATMLPLITRISTRVLLGEDLCRNEEWIRIASSYSVTSTTVAGRLRRWPQHLRYIVSLLSPQCWELRKQVSDSHALIDPILERRRSEEKGTVYNDSLEWFEKTAKAAYDPADTQLFLTAVSIHTTVDLLSQALEDICAHPEIIGPLQDEIRTVIKEEGWNTKALYKMKLLDSALKETQRLKPVQIASMMREALVDVTLQDGTFIPKGHQLAVSCHNMRDEKIYPNANEWDGYRFYRERQEADAAREDKIQLSSTSVEHMGFGYGEHACPGRFFAAKEVKIVMMYLLLNYEWRIPEGTKPNPVSCCTIWVTDPTFEIEVRKKGSEDPALELAY

SEQ ID NO: 1509 - protein, 508 aa, Fusarium
  misc_feature (1)..(508): Public GI ID no. 270160664
  misc_feature (1)..(508): Fusarium sp. FRC R-06979
  misc_feature (179)..(480): Pfam Name: p450 Pfam Description: Cytochrome P450
  misc_feature (1)..(508): Bit score of 562.2 for HMM based on sequences of Figure 6
  misc_feature (1)..(508): Functional Homolog Of SEQ ID NO. 1429
MLNLIKDMPTSAYPLCFIFFILALAIRRLLAPKPSAPLLNPRRFYEFSDNGPVSRILNTTRKTIEEWFAKNPQTPMRLICDLGEITVLPPSMADEIKKDSRLSFIKASNDSAFHISIPGFEPYREGGKHEAALVKNVVHGHLKKTLNRITLPLAQETYLAIDEYLGSSQEWHKIPLNATMLPLITRISTRVLLGEDLCRNEEWIRIASSYSVTSTTVAGRLRRWPQHLRYIVSLLSPQCWELRKQVGDSHALIDPILEKRRSEEKGTVYNDSLEWFEETAKAAYDPADTQLFLTAVSIHTTVDLLSQALEDICAHPEIIGPLQDEIRSVIKEEGWNTKALYKMHLLDSALKETQRLKPVQIASMMREALVDVTLQDGTFIPKGHQLAVSCHNMRDEKIYPNADEWDGYRFYRERQEADAAREDKIQLSSTSVEHMGFGYGEHACPGRFFAAKEVKIVMMYLLLNYEWRIPEGTKPNPVSCCTIWVTDPTFEIEVRKKPSEDPALELAY

SEQ ID NO: 1510 - protein, 554 aa, Cordyceps militaris
  misc_feature (1)..(554): Public GI ID no. 346325649
  misc_feature (1)..(554): Cordyceps militaris CM01
  misc_feature (255)..(531): Pfam Name: p450 Pfam Description: Cytochrome P450
  misc_feature (1)..(554): Bit score of 588.8 for HMM based on sequences of Figure 6
  misc_feature (1)..(554): Functional Homolog Of SEQ ID NO. 1429
MLVGFKSYLEALPHEVALKPVPFILASVLAAVLAVVLRLATAAPSTLTTLNPKGAFEVSDARIKATFRRDAAKMLRGWFAQNPSRPVIINGDMGPMTVLPPTMTNEIRNDNRLGFMEVTREAFHSHLHGFEPFSVGQSDHLIQEIVRKDLTKQLAKVTAPLAEETSLALSDILTDSTGMSIPERGGALPCHASLCPKLIHAPPTEWHEANVRESILQLVARISSRVFVGEELCRNPDWLRVTKEYTVASFQASEELRQWPYLLRPIANRFLASTRRAQTLLKEARAVVTPVITRRYAARAAAAAAATPYVESNDAMDWFASADPQRFFDAANFQLALSFAAIHTTTDLLSETLLRIAQHPEIVPALRAEIISVYRSHGWEKSALYKMQLLDSTIKETQRMKPISQRKFPPGLSMIRFIKESFTLSDGTRLRKGEKLGVTLTHLRAASNHADPDRWDAYRWVRMRDDPARQNAAHLVSTTPEHSAFGHGQHACPGRFFAANEIKVALLGILIKYDFELPADTLPQVYENGLSLVSDPMVSMRFRRRDAEIDLDMA

SEQ ID NO: 1511 - protein, 519 aa, Aspergillus niger
  misc_feature (1)..(519): Public GI ID no. 134079537
  misc_feature (154)..(498): Pfam Name: p450 Pfam Description: Cytochrome P450
  misc_feature (1)..(519): Bit score of 553.9 for HMM based on sequences of Figure 6
  misc_feature (1)..(519): Functional Homolog Of SEQ ID NO. 1429
MELKVDVKEHGNPLSLGTSIILLSLVLIFLLRWKDTPASQNGLPLINAKRRFEFVDLLAKKRFITNAQELLKAATNRVIDPIKASVFNIVTENGVMMVLDPKYADEIRNSKILSLRKTLIEDMHVNVPGFEQQMQALEDDEIFQTTLKTKLTRNLEDLNEILSQEATVALQEHWTDNPEWHEIPLSRSMLKIIAQLSSRVFLGDKICHNPKWLRISVDYSIDLFQATFELRIYPRFLRPLASRFQPSCRRLRADIREARSIIEPVIEERRKAKAIAKQEGRDPERHEDTIEWLEEVANGRQYNPVSAQLLLSSAAVHTSSDMLTQVLYDLDGRQELIEALREEIRSVFKNGWERSSLAKLRLMDSMLRESQRLKPISSVSMRRMAEAPVTLSDGTIIPKDCKIIVPCLRQWDEKYYPDPETFVPDRFLKLRNEPGYEHTAAFANSSPNHLGFGLGRHACPGRFFAANEIKLALCHILMKYEFRVVGKKPEKVVFGTMLAADPNGVIAVRRRKGEEQIRL

SEQ ID NO: 1512 - protein, 512 aa, Gibberella zeae
  misc_feature (1)..(512): Public GI ID no. 46102962
  misc_feature (1)..(512): Gibberella zeae PH-1
  misc_feature (167)..(478): Pfam Name: p450 Pfam Description: Cytochrome P450
  misc_feature (1)..(512): Bit score of 592.6 for HMM based on sequences of Figure 6
  misc_feature (1)..(512): Functional Homolog Of SEQ ID NO. 1429
MALITSLQDVRLDMLAYFVAFLVVVSVVRKKLAPQPSAYLLNPRRWYEFTDARAVSEVLHTTRQTLEEWFHKHPTTPVRLTTDFGEMTFLPPTLADEIKSDKRLSFIKAANDSAFHTEIPGFEPFREGGRNEAALIKEVIHGQLKKTLNKMTFPLAQETQLAVEHYLGANKEWHKIRLRDALLPLVTRISTRIFLGEDLCQNDKWISITSEYAANSLEVANRLRVWPKYMRYVVSYFSPGCGILRNQVKNARELITPIVERRRSEEKGKEYNDSLGWFEKTAKQAYNPAATQLFLSAVSVHTTTDLICQCLEDIAAHPEIIKPLQEEIRRVIAEEGWNTKAMYKMFLLDSVFKETQRLKPIQVASMVREAQSDITLSDGTFIPKGHQIAVSCHNMRDGRIYENPEKWDGYRFFRERQQSAREDKVQLSSTSVEHMGFGYGEHACPGRFFAAKQVKIVMMYLLLNYEWKIPEGPEPQLMAWCTTWVTDPDYEVLMRRKDKDDPCLRLELVQDD

SEQ ID NO: 1513 - protein, 508 aa, Fusarium camptoceras
  misc_feature (1)..(508): Public GI ID no. 270160658
  misc_feature (141)..(480): Pfam Name: p450 Pfam Description: Cytochrome P450
  misc_feature (1)..(508): Bit score of 563.4 for HMM based on sequences of Figure 6
  misc_feature (1)..(508): Functional Homolog Of SEQ ID NO. 1429
MLNIVNNMPISAYPVCFLFAILALAVRRILTPKPSAPLLNPRRFYEFSDYGPVSRILTNTRETIEEWFAKNPETPMRLISDLGEVTVLPPSMADEIKKDSRLSFIKASNDSAFHISIPGFEPFREGGKHEAALVKNVVHGHLKKTLNRITLPLAQETYMAIDEYLGSSQEWHKIPLNATMLPLMTRISTRVLLGEDLCRNEEWIRIASSYSVTSTTVAGRLRRWPQYLRYAVSLLSPQCWELRKQVSDSHALIDPILARRRSEEKGTVYNDSLEWFEKAAKAAYDPADTQLFLTAVSIHTTVDLLSQALEDICAHPEIIGPLQDEMRSVIKEEGWNTKALYKMKLLDSALKETQRLKPVQIASMMREALEDITLKDGTFVPKGHQLAVSCHAMRDEKIYPNANEWDGYRFYREREEADAAREDKIQLSSTSVEHMGFGYGDHACPGRFFAAKEVKIVMMYLLLNYEWRIPEGTKPTPVSCCTLWVTDPTFEIELRKKPSEDPALELAY

SEQ ID NO: 1514 - protein, 508 aa, Fusarium poae
  misc_feature (1)..(508): Public GI ID no. 270160632
  misc_feature (159)..(478): Pfam Name: p450 Pfam Description: Cytochrome P450
  misc_feature (1)..(508): Bit score of 572.9 for HMM based on sequences of Figure 6
  misc_feature (1)..(508): Functional Homolog Of SEQ ID NO. 1429
MSIIDRMPDVRVDMLAYLSLFVILTLAVRSYLTPKPSAPLLNPKRWYEFTSSRAVTEVLHTTRSILEDWFAKNPTKPMRLTCDLGDITFLPPSMADEIKRDPRLSFIKAANDSAFHVDIPGFEPYREGGRHEAALIKDVVHGNLKKTLNHITIPLAQETQMAVEEYLGSNQNWHKVPLRATMIPLITRISTRVLLGEDLCRNEKWLEISSTYAATSSEVAGRLRRWPRAMRYIVSMLSSECSALRTQVKDANDLINSVLERRRSDEKGTSYNDSLEWFEKTAREPYDPAGTQLFLSAVSIHTTADLLCSALEDIAAHPEIIEPLQKEIREVIKQEGWNTKAVYKMFLLDSALKETQRLRPVQIASMMREALEDITLEDGTFIPKGHQLAVSCHNMRDEKIYPNAEQWDGYRFYREREQSAREDSVQLSSTSLEHMGFGYGKHACPGRFFAAKEVKIVMMFLLLNYEWRMPKDSKPNPVSCCTTWVTDPTFKIEARRKAKDDPALEIPL

SEQ ID NO: 1515 - protein, 512 aa, Fusarium culmorum
  misc_feature (1)..(512): Public GI ID no. 270160623
  misc_feature (166)..(478): Pfam Name: p450 Pfam Description: Cytochrome P450
  misc_feature (1)..(512): Bit score of 584.9 for HMM based on sequences of Figure 6
  misc_feature (1)..(512): Functional Homolog Of SEQ ID NO. 1429
MAIISSLSDVRLDMLAYFVAFLVVVSVVRKKLAPKPSAYLLNPRRWYEFTDARAVSEVLHTTRQTLEEWFHKHPTTPVRLTTDFGEMTFLPPTLADEIKSDKRLSFIKAANESAFHTEIPGFEPFREGGRNEAGLIKEVIHGQLKKTLNKMTFPLAQETQLAVEHYLGANKEWPKIRLRDALLPLVTRISTRIFLGEDLCQNDKWISITSEYAANSLEVANRPRVWPKYMRYVVSYFSPGCGILRNQVKNARELITPIVERRRSEEKGKEYNDSLGWFEKTAKQAYNPAATQLFLSAVSVHTTTDLICQCLEDIAAHPEIIKPLQEEIRRVIAEEGWNTKAMYKMFLLDSVFKETQRLKPIQVASMVREAQSDITLSDGTFIPKGHQIAVSCHNMRDGRIYENPEKWDGYRFFRERQQSAREDKVQLSSTSVEHMGFGYGEHACPGRFFAAKQVKIVMMYLLLNYEWKIPEGPEPQLMAWCTTWVTDPDYEVLMRRKDKDDPCLRLELVQDD

SEQ ID NO: 1516 - protein, 502 aa, Magnaporthe oryzae
  misc_feature (1)..(502): Public GI ID no. 145606494
  misc_feature (1)..(502): Magnaporthe oryzae 70-15
  misc_feature (163)..(478): Pfam Name: p450 Pfam Description: Cytochrome P450
  misc_feature (1)..(502): Bit score of 472.0 for HMM based on sequences of Figure 6
  misc_feature (1)..(502): Functional Homolog Of SEQ ID NO. 1429
MASSINASPTWPQGQLPGLSALASLDLDRSTIAITLAAIVILPLLVSYIASSLRGEKVPVVNPPGRFQTALQKSIEFGTAGFKIFQQAQEQFPNQPFKLLSNAGYTTVLPPDRALEVKQHPNLSFRKAFSTILPANSEGAAALGVVDHPSEIIQKIVTKHLTKRLKWTEIKVYEPITDVIARVSSRVFLGDKLCRDAAWLDITKSFAQTAMAVIMTMRAFPTWIRPLVFQFASYGKEYRALYRRGHNAIMPIMKERQEERAECAAKGVPAPVYNDLIEWAETEAGNNSFDMTAVQLSISMAAIHTTSDLVSQNILLLSTRPDFVDALRKEMIEVLPAKGWKKTSLTSLRLLDSAIKEAQRLKPTSVSGITLRKGEYSAVDATRVWDPKLHKNPDEFDIYRFYEARKQPGGEHVHQLVSTSPDHIAFGLGKYACPGRFFASNETKVVLCHLLLKYDWKLAEGSSTDFTYFGTELTINPETKVLYRRRKEEFDLDALATDEEAS

SEQ ID NO: 1517 - protein, 516 aa, Aspergillus kawachii
  misc_feature (1)..(516): Public GI ID no. 358367412
  misc_feature (1)..(516): Aspergillus kawachii IFO 4308
  misc_feature (77)..(489): Pfam Name: p450 Pfam Description: Cytochrome P450
  misc_feature (1)..(516): Bit score of 540.7 for HMM based on sequences of Figure 6
  misc_feature (1)..(516): Functional Homolog Of SEQ ID NO. 1429
MAVILEVLDNQHLLQGVVLALVLVFVSSFYHELADSFPYKNIPIIGKSKWEITNTKAKQRFVTSAKELFAEGFSQGRKSFQVVFSARPTIVLHPSLVDEVKNHPLLDFNEANKKSFFGSKIPGFEPFDGLDHEGIFLEVINKKITQGLGQLITPLSRETATVMNEKLPDTGEWLSFNFAQEISHIVARLSSLVFLGEKICRDKQWLDVSVNYTIHAFVAARDLRLYPSILRPFVHWFLPSTRETRKDIRIASGIINREVEKRKLIREGKLPEEDPPRTHADTLDWFEEVAAGRPIDIAVSQVGLSLAAIHTTSNLLTNIMYDLTAYPEHIQPLRDEIIAIVSEDGGLKKTSLTKMKLMDSVLKESQRMHAAGIAFLNRLAMGDIMLSDGTRIPKGASVTVSAHNMEDENLYPNAKTYDGFRFYKKRQEPGNEHRFQFVTTSPEHLGFGHGMHACPGRFFASNEVKILLIHFLMRYDWKFADGRTTRPMNFMHGTESICDPTVEFLFKPRQPEVDLS

SEQ ID NO: 1518 - protein, 509 aa, Fusarium venenatum
  misc_feature (1)..(509): Public GI ID no. 270160641
  misc_feature (152)..(481): Pfam Name: p450 Pfam Description: Cytochrome P450
  misc_feature (1)..(509): Bit score of 556.0 for HMM based on sequences of Figure 6
  misc_feature (1)..(509): Functional Homolog Of SEQ ID NO. 1429
MSIIDRMPEVRIDMLAYVSLFVILTLAIRSYLVPKPSAPLLNPRRFYEFSDDGPVSRILTTTRQTIEEWFSKHPATPMRLICDLGEITILPPSMADSIKKDSRLSFIKASNDSAFHISIPGFEPFREGGMHEAALVKNVVHGYLKKELNRITLPLAQETYMAIEDYIGSSKDWHKVPLRDTMLPLITRISSRVLLGEDLCRNEEWIRIASEYSVTSTDMAARLRRWPQYLRYTVSLFSRQCRVLRKQVSDSHAFIDPILERRRLEEKGTVYNDSLEWFEKTAKAPYDPADTQLFLTAVSIHTTVDLLCQAITDICAHPEIIGPLQDEIREVIKEEGWNTKALYKMKLLDSALKETQRLKPVQIASMVREALEDITLEDGTFIPKGHQLAVSCHNMRDEKIYPNADEWDGYRFFREREQADAAREDKIQLSSTSAEHMGFGYGEHACPGRFFAAKEVKIVMMYLLLNYEWRIPQGTKSEPVKCCTIWVTDPTFALEARKKGDDPALHLAY

SEQ ID NO: 1519 - protein, 512 aa, Fusarium kyushuense
  misc_feature (1)..(512): Public GI ID no. 270160627
  misc_feature (150)..(485): Pfam Name: p450 Pfam Description: Cytochrome P450
  misc_feature (1)..(512): Bit score of 562.6 for HMM based on sequences of Figure 6
  misc_feature (1)..(512): Functional Homolog Of SEQ ID NO. 1429
MAVMSIIDRMPDVSPEVLAYLSLFVILTLAVRRYLAPKPSAPLLNPRRFYEFSDDGPVSRILTTTRQTIEEWFSKHPATPMRLICDLGEITILPPSMADSIKKDSRLSFIKASNDSAFHISIPGFEPFREGGMHEAALVKNVVHGYLKKELNRVTLPLAQETYMAIEDYIGSSKDWHKVPLRDTMLPLITRISSRVLLGEDLCRNEEWIRIASEYSVTSTDMAARLRRWPQYLRYIVSLLSPQCRVLRKQVSDSHAFIDPILQRRRSEEKGTVYNDSLEWFEKTAKAPYDPADTQLFLTAVSIHTTVDLLCQALADICAHPEIIGPLQDEIREVIKEEGWNTKALYKMKLHDSALKETQRLKPVQIASMVREALEDITLEDGTFIPKGHQLAVSCHNMRDEKIYPNPDQWDGYRFFREREQADAAREDKIQLSSTSVEHMGFGYGEHACPGRFFAAKEVKIVMMYLLLNYEWRIPEGTKPEPVKCCTIWVTDPTFALEARKKGDDPALKLSY

SEQ ID NO: 1520 - protein, 506 aa, Aspergillus kawachii
  misc_feature (1)..(506): Public GI ID no. 358372883
  misc_feature (1)..(506): Aspergillus kawachii IFO 4308
  misc_feature (116)..(478): Pfam Name: p450 Pfam Description: Cytochrome P450
  misc_feature (1)..(506): Bit score of 561.0 for HMM based on sequences of Figure 6
  misc_feature (1)..(506): Functional Homolog Of SEQ ID NO. 1429
MFTTNTILYLTKLESTTWIWAPVLAAIIFWLLSTPSLKTPLPVINQRQRFEIGGLGSLKRFFKDAHGLIRTGFSQGSAFYLYSEFGPKIVLAPKHADDFRTHPAFSLSNAIAEEFHAHIRGFDPFKQDPALVKDVLRTKLTPSLDKLARPLSEDTRRALGEMFTDDPEWHDLQLKPIVASLISRLSSRVFLGEKLSRNPNWHRVTADYAVHTFMSALFLRMFPRCTRPYVAYVLPFCRKIRNEIKEAEEIITPVVEERRSAKQEAIRQGQQPEHYEDAMQWMEECAKGRPYDPTLAQIALSLAAIHTTSDLLTQTLFYLAEREDVIKALRNEVITVLQNDGWTKSTFNDLKLMDSVLKESQRLKPHTGMRRFAQEDVTLSDGTVLPKGTISVLTSEPMWDPTIYPEPETFDAYRFLKMRETPGLETAAQAVSISPQHLAFGLGKHACPGRFFAIALNKIILCHVLLEYDFKVADGWNPTVRKYGFVWQADPVAKVSVRRRKEEIVL

SEQ ID NO: 1521 - protein, 524 aa, Zymoseptoria tritici
  misc_feature (1)..(524): Public GI ID no. 339469697
  misc_feature (1)..(524): Zymoseptoria tritici IPO323
  misc_feature (146)..(489): Pfam Name: p450 Pfam Description: Cytochrome P450
  misc_feature (1)..(524): Bit score of 489.7 for HMM based on sequences of Figure 6
  misc_feature (1)..(524): Functional Homolog Of SEQ ID NO. 1429
MTTIELLRGAVNTIVGPERIIPWPATLAIAAVGWWILSSWLRPVSKFPTINDPKENWTSFPAKKAYLKNCQHLLKEGARKFSGPFNLTTDNGTTMLIFSPEYIDAINEQESLSFPEYAIRNLNLKGYKTFRTFGPQPDHMFYEAVIKGLTRNLAKFTKPLSLEMDACLLSSWGESTEWHSVEAKEDVLDFVARLSSLIFLGPDFVHNKEWIRIAKNYTVDTFTAIAICRYIPALIRPLFVQFLPLCRKVRRDYTTCANILAPVLASREAELKAAKSESRPPNLPDDAIEWFRNAAHGREYNQTDVQVSLQVASIHTTTDLLAQAILNLCAHPEMVVPLREEAIAVLSTQGWQKTALTSLHLLDSFLKETQRLKPINVTSLHRYATRDTTLSGGIHIPQGTNLGIHSYNLFNPDIYTSPETFDGYRYLRLRQSDPKWEHKGHLVSTSVEHTGFAHGKNACPGRFFAANEVKIAMVHVLLKYDVKVERKEDAMWITYGPNCYVNPKARMWVRRRREEVDLEALARE

SEQ ID NO: 1522 - protein, 508 aa, Fusarium
  misc_feature (1)..(508): Public GI ID no. 270160647
  misc_feature (1)..(508): Fusarium sp. NRRL 36351
  misc_feature (157)..(479): Pfam Name: p450 Pfam Description: Cytochrome P450
  misc_feature (1)..(508): Bit score of 569.1 for HMM based on sequences of Figure 6
  misc_feature (1)..(508): Functional Homolog Of SEQ ID NO. 1429
MALISSMPDLRLYVLAFFVLLVVLTLAVRRSLTPKPSATLLNPRRWYEFTNYRAVTEVLHTTRSILEDWFAKNPTTPMRLLCDLGDITFLPPSMADEIKRDPRLSFIKAANDSAFHIDIPGFEPYREGGRHEAALIKDVVHGNLKKTLNHITIPLAQETQMAVEEYLGSNQEWHKVPLRKTMIPLITRISTRVLLGEDLCRDEKWLEISSTYAATSSEVAGRLRRWPRALRYIVSMLSSECGALRAQVKDANDLVNSVLKRRQSDEKGTTYNDSLEWFENTAKEPYDPAGTQLFLSAVSIHTTADLLCSALEDIAAHPEIIEPLKKEIREVIKQEGWNTKAVYKMFLLDSALKETQRLRPVQIASMMRETLEDITLSDGTFIPKGHQLAVSCHNMRDEKIYPNADTWDGYRFYRERQQSAREDSVQLSSTSLEHMGFGYGKHACPGRFFAAKEVKIVMMFLLLNYEWRMPKDSKPNPISCCTTWVTDPFFEIDARRKAKDDPALELPH

SEQ ID NO: 1523 - protein, 492 aa, Colletotrichum higginsianum
  misc_feature (1)..(492): Public GI ID no. 380479505
  misc_feature (135)..(478): Pfam Name: p450 Pfam Description: Cytochrome P450
  misc_feature (1)..(492): Bit score of 540.7 for HMM based on sequences of Figure 6
  misc_feature (1)..(492): Functional Homolog Of SEQ ID NO. 1429
MGNGGHVPYLMALLLVVSVMAVSLRPNKLSAFPVINGSKNEYLRNGRAMLARGMREYGNKPFRVNTGLGGGVIILNSSAMPEVKNDHRFDSTKFLLQYWQAGIPGFEPYIALGTEILHNVIKWNLTPAGIAKLNKPLSDEANSALKDILTDNEEWHEVLLGDVLIRIVARVSSVIFLGPELCRNPDWLKITVNYTNKATNAAKVLRRWPVFLYRVVHWLLPECREARRMVVEGRETIAPILEKRRAQKAADPSLEFHDALDWYESAAKKMGVDYDAASQQLGLSISAILTSNDLMSQSIMDLCQNPEMFEPLRNEIRSVLGDGGWKPATLFNMKLLDSVLKESLRLKPVAAVAMGRRVMSEVRLKDGTRLPSECGIALSAEKMWDPEVYKNPRAYDGYRFLHMREASEQGEKTAQLVSTSPEHLGFGLGIHACPGRFFGANTVKLVMCHLLLKYDIKLAENTSTMPLEFGFSMLANPTTKVLIRRRKEQVHF

SEQ ID NO: 1524 - protein, 523 aa, Aspergillus oryzae
  misc_feature (1)..(523): Public GI ID no. 169769747
  misc_feature (94)..(489): Pfam Name: p450 Pfam Description: Cytochrome P450
  misc_feature (1)..(523): Bit score of 539.2 for HMM based on sequences of Figure 6
  misc_feature (1)..(523): Functional Homolog Of SEQ ID NO. 1429
MPVLATFLESHYFFQGIAVALALIFVSNFYRELADGLPYRKIPLVGRSRWEISNTKAKKLFVTSAKDLMVQGFSQGRTVFQAMFTAGPTIVLHPRYVDELKNHPHLDFGEAVRKSFFGATIPGFEPFNNQTKEDIVIEVINKKLTHTLGQLTIPLSKETAAVLTDKLPGSDEWKPFTFAQEIPHMVARLSSLVFLGEKICRNETWLDVSVNYTIDAFNAARELRDLPAVARPFIHWFMPSMQKLRHHRKVAAEIVQQEIIKRDMIREGKLPEENPPRTHADALDWFREVAAGRPCDETVSQIGLSVAAIHTTSNMLTNVMYDLTAHPEYIQPLRDEIKAIVEQDGILKKTSLTKMKLMDSVMKESQRTNPVSIAFFNRIATEAVVLSDGTSIPKGANVVVSAHVMEDESIYPNAKVYDGFRFYNKRQVPGNEHRYQFVTTSPEHLGFGHGMHACPGRFFANNEIKILLAHLLLKYDWKFADRVDRPKSFLHGTEIICDPTVKLLYKSRQPEVDLSALGEGTTD

SEQ ID NO: 1525 - protein, 536 aa, Penicillium marneffei
  misc_feature (1)..(536): Public GI ID no. 212536382
  misc_feature (1)..(536): Penicillium marneffei ATCC 18224
  misc_feature (107)..(517): Pfam Name: p450 Pfam Description: Cytochrome P450
  misc_feature (1)..(536): Bit score of 563.7 for HMM based on sequences of Figure 6
  misc_feature (1)..(536): Functional Homolog Of SEQ ID NO. 1429
MTFTTRLVVDTHHYAQNLTQDFDFTSLSTSKDLTFGLVGGIVLFAVFAQWIIKTYKFWQYPFVNKASWWNPSKAKENYLWNAQQLLVDGFHQSPKGYIMDTDMARTVLLSPEYANEVRSDPRLNFRKHNAKDFLGNLFTFQLFQDRKNFGELVNVMVRTKLTQSLGLITKAISEEMTDVLHHQWTEDAEWHAINLKNTMLEVIAQLSSRIFLGPELCRNMDWQRITIDYTVNIFMAVAAVKRYPKPLHLLVQWILPETRVVRVQMAEARRIIQPVIDQRKKEMFGEKKITGDKSTEATRKHTDSIQWLLELSGGTDYDTALAQLSLSMAAIHTTGDLITQVIYDICEHPELIQPLREEAIAVLGTDGWKRTSLYNLKLMDSVLKESQRIKPAGMVSMRRIATDNITLKDGRRIPKDSMIAVSGHWSWDKSIYENPDQFDGYRFYKMSQNPKTEQMSHLVATSPQHIAFGHGKHACPGRFFAANEVKIALVHILLKYDLKLDKSSPPPKIFKMGWMMQSDSQAKILVRRRKEEISLD

SEQ ID NO: 1526 - protein, 513 aa, Glomerella graminicola
  misc_feature (1)..(513): Public GI ID no. 310800499
  misc_feature (1)..(513): Glomerella graminicola M1.001
  misc_feature (175)..(487): Pfam Name: p450 Pfam Description: Cytochrome P450
  misc_feature (1)..(513): Bit score of 471.1 for HMM based on sequences of Figure 6
  misc_feature (1)..(513): Functional Homolog Of SEQ ID NO. 1429
MSLQGLYQVLHRIAVGYLPLVAAAVVIAIAYKLKKQSETERPLKGFPLVGLEEEGLSPKEAWMKHGHRVMAKGLAANKSAFQVMTGTGPKIMLPNRFTEEFRKNEMANLIQSQTRDNFAGWPGFDGMTFLSQHERVVVDAVRINLTQSMGAVTDSLVDEARLATPDVFGNNKEWHTISIKSLTGHFVSRLSSRVFLGPKLCRDPEWLAIAQSHTVNLFQASVAMRDGPSLRRIISVWFNPMYRQLRSQVREARRILKPLIEKRKTEVRKALAAGKKPEKVADLIGWMVAQARASDIDYTAGQLGMSVVGIHTTTEALAEALVDLCQHPELFKPLREEIVRELKDEGWTRTTLHRMRLMDSFLKESQRMHPASAASVNRYLYADVRLSDGTVLPKGSRVWIAGRFDDPELYPEPEKLDAYRFLNLRSKSGKSNTWQHTSMTPEHLGFGYGDHGCPGRFFASNELKIALCFLLLHYDWKLPDAPDNPTFIHIGIGNLLSPLCRLSYCRRTAEIEL

SEQ ID NO: 1527 - protein, 524 aa, Glomerella graminicola
  misc_feature (1)..(524): Public GI ID no. 310801547
  misc_feature (1)..(524): Glomerella graminicola M1.001
  misc_feature (150)..(504): Pfam Name: p450 Pfam Description: Cytochrome P450
  misc_feature (1)..(524): Bit score of 497.9 for HMM based on sequences of Figure 6
  misc_feature (1)..(524): Functional Homolog Of SEQ ID NO. 1429
MSSLRSLVNASRADMLSFDSWTSSGASLHALYLITAALSLLFMYSQRESYPKLPRLNPKKFTELTWSARLFDYAIRSRELFAEGTRKFPDRPYKLFTDLGDVIVVPNKYAEELKSSRDLDFNGSARDAFHDYIPGLTPLHTDMRMRYVIQNYMTKTLPSLTEQISQEAIKALREIFPNSKDWTEVTPDKVMHVMSRMSSRIFMGDELCNDMEWIKASSEYIHLAGHGVFELSRWPRALRSWVHWFLPTFTEIRRRLAHCRAVLQPHIDRRVAVKKAAAERGEPNPYNDSIEWFSRELTPGADPTEVQINLTILAVHTTTDLLVQTLVDIAKNPEILGPLREETIHVLKTDGFKKSGLQKLRLMDACFKESQRLRPIFLAYFRRQALVDITLEDGFVIKKGTLVAMDGRRVLHNEDYYPDPLRWDPYRYFQMREAGEEHKSHFVTSSDKHIGFGHGIHACPGRFFAAHELKIIFSHILLMYDWTIPEDVKSLPNMTAGSHYMMPPGTRFLFTRRQEELDFSALEY

SEQ ID NO: 1528 - protein, 524 aa, Aspergillus terreus
  misc_feature (1)..(524): Public GI ID no. 115398866
  misc_feature (1)..(524): Aspergillus terreus NIH2624
  misc_feature (79)..(484): Pfam Name: p450 Pfam Description: Cytochrome P450
  misc_feature (1)..(524): Bit score of 533.0 for HMM based on sequences of Figure 6
  misc_feature (1)..(524): Functional Homolog Of SEQ ID NO. 1429
MTVILDVLDTHHLVQGIAVALLLVFVSSFYGDLADGIPYRNIPLVGRSRWEISNKKAKQRFVSSAKELMAQGFSQGRTVFQLMFAQSATIVLHPKYVNEIKNNPSLNFDEANKKSFFGSKIPGFEPFDGIDKEGILLEVINKKLTHTLGQLTIPLSRETATVLSEKLPKSGEWQSFTFAQEIPHIVARLSSLVFLGQKICRNQEWLNVSVNYTIDAFLAARDLRLWPSVTRRIVHWFLPSAKRLRHHTVVATEIIQAEIQKRELIRTGKLPEEDPPRTHADALDWFAEVAAGRPFNVIRSQIGLSLAAIHTTSNLLTNIMYDLTAYPEHIQPLRDEIKAIVDEDGMLKKTSLTKMKRMDSVMKETQRLNGAGIAFLNRIAMDEVILSDGTRIPKGASITVSAHHMRDESIYPDAQTYRGFRFYDKRQEAGNEHRFQFVTTSPEHLGFGHGIHACPGRFFAANEVKILLAHLLLKYDWKFAEDVGAGRPPNIMHGVENICNPTIKLLYKARQPEVDLAALGEGAE

SEQ ID NO: 1529 - protein, 524 aa, Aspergillus fumigatus
  misc_feature (1)..(524): Public GI ID no. 146324413
  misc_feature (1)..(524): Aspergillus fumigatus Af293
  misc_feature (94)..(484): Pfam Name: p450 Pfam Description: Cytochrome P450
  misc_feature (1)..(524): Bit score of 524.5 for HMM based on sequences of Figure 6
  misc_feature (1)..(524): Functional Homolog Of SEQ ID NO. 1429
MALIFELLQSPYFLQGIAVSLLLVIVSNFYQELVDGFPYRNIPLVGMSRWGFTNSKAKERFVASAKALIAQGFSQGRTAFQVMFSHAPMIVLHPRYMDEVKSHPHLTFDEANRKAFFGAKLPGFEPFGLDKITVDVINNKLTHALGSLTTSLSRESAAVVKESLPPKSDEWQSLVFAQEIPYIVARLSSLVFMGEKVCRDKEWLHVSVNYTIDAFGAARELRLWPSVTQPLVHWFLPSTRRVRKHISVAKKIVQKEIEKRELIRQGKLLEYSPPKPNDALDWFREVAAGRPYDITKSQITLSLAAIHTTSNLLTNIMYDLIAYQEYIQPLRDEIVAVVKEEGCLKKTSLTKLKLMDSFIKETQRLNPVSITSLQRYALADITLSDGTFIPKGAMLIMSAHTMKDESIYPHADTFDGYRFYNKRKEPGNEHRYQLVTTSNEHLGFGHGLHACPGRFFAANEVKILLIHLLLKYDWKFAEDRGRPQSIMYGTEIICDPTVKLLYKARTPEIDPSKLGELSTDSPSV

SEQ ID NO: 1530 - protein, 524 aa, Aspergillus fumigatus
  misc_feature (1)..(524): Public GI ID no. 159124267
  misc_feature (1)..(524): Aspergillus fumigatus A1163
  misc_feature (89)..(484): Pfam Name: p450 Pfam Description: Cytochrome P450
  misc_feature (1)..(524): Bit score of 525.0 for HMM based on sequences of Figure 6
  misc_feature (1)..(524): Functional Homolog Of SEQ ID NO. 1429
MALIFELLQSPYFLQGIAVSLLLVIVSNFYQELVDGFPYRNIPLVGMSRWGFANSKAKERFVASAKALIAQGFSQGRTAFQVMFSHAPMIVLHPRYMDEVKSHPHLTFDEANRKAFFGAKLPGFEPFGLDKITVDVINNKLTHALGSLTTSLSRESAAVLKESLPPKSDEWQSLVFAQEIPYIVARLSSLVFMGEKVCRDKEWLHVSVNYTIDAFGAARELRLWPSVTQPLVHWFLPSTRRVRKHISVAKKIVQKEIEKRELIRQGKLLEYSPPKPNDALDWFREVAAGRPYDITKSQITLSLAAIHTTSNLLTNIMYDLIAYQEYIQPLRDEIVAVVKEEGCLKKTSLTKLKLMDSFIKETQRLNPVSITSLQRYALADITLSDGTFIPKGAMLIMSAHTMKDESIYPHADTFDGYRFYNKRKEPGNEHRYQLVTTSNEHLGFGHGLHACPGRFFAANEVKILLIHLLLKYDWKFAEDRGRPQSIMYGTEIICDPTVKLLYKARTPEIDPSKLGELSTDSPSV

SEQ ID NO: 1531 - protein, 516 aa, Aspergillus niger
  misc_feature (1)..(516): Public GI ID no. 317032179
  misc_feature (1)..(516): Aspergillus niger CBS 513.88
  misc_feature (78)..(489): Pfam Name: p450 Pfam Description: Cytochrome P450
  misc_feature (1)..(516): Bit score of 538.0 for HMM based on sequences of Figure 6
  misc_feature (1)..(516): Functional Homolog Of SEQ ID NO. 1429
MAVILEVLDNQHLLQGVVLALVLVFVSSFYHEIADSFPYKNIPLVGKGKWEITNTKAKHRFVTSAKELFAEGFSQGRKAFQVHFSARPTIVLHPSLTNEVKNNPLLDFNEANKKSFFGSKIPGFEPFDGLDHEGIFLEVINKKITQGLGQLTTPLSRETIAVLNEKLPDSGEWLPFTFAQEIPHIVARLSSLVFLGEKICRDKQWLDVSVNYTIHAFVAARDLRLYPTVLRPFVHWFLSSTRRTRQDIRVASAIINREVEKRILIREGKLPEEDPPRTHADTLDWFEEVAAGRPLDLAVAQVGLSLAAIHTTSNLLTNIMYDLTAYPEHIQPLRDEIKAIISEDGGLKKTSLTKMKMMDSVLKESQRMHPAGVAFINRVAMGDITLSDGTRIPKGASIAVSAHNMEDESLYPNAKTYDGFRFYKKRQEPGNEHRFQFVTTSPEHLGFGHGMHACPGRFFASNEVKILLIHFLMRYDWKFADGRTTRPMNFMHGTESICDPTVEFLFKPRQPEVDLS

SEQ ID NO: 1532 - protein, 524 aa, Aspergillus clavatus
  misc_feature (1)..(524): Public GI ID no. 121699333
  misc_feature (1)..(524): Aspergillus clavatus NRRL 1
  misc_feature (75)..(487): Pfam Name: p450 Pfam Description: Cytochrome P450
  misc_feature (1)..(524): Bit score of 528.1 for HMM based on sequences of Figure 6
  misc_feature (1)..(524): Functional Homolog Of SEQ ID NO. 1429
MALISELLESRYLLQGIALAFFLVIVSHFYQELADGYPYRNIPLVGRSRWELSNGKAKDRFVKSAKELMAQGFSQGRTVFQLMFTHTPMIVLHPKFIDEIKSHPHLNFDEANKKAFFGSKIPGFEPFEGLDKDHILLDVINKKLTHTLGNLTIPLSQETAAVVKETMPPRTDEWQPLMFAREIPYLVARLSSLVFLGEKICRDKEWLNVSVNYTTDAFIGARALRLWPTITRPVVHWFLPSTRRVRKHIRVAKKIVQDEIQKRELIRQGKLPAEDPPRTHADALDWFREVAAGRPFDETRNQIGLSLAAIHTTSNLLTNVMYDLVAYQEYIQPLRDEIRAVMEEDGSLRKTSLTKLKLMDSVMKESQRMNPVSIAFLQRLAKADLTLSDGTYIPKGATLIVSAHAMRDESIYPDANQYDGYRFYNKRQEPGNEHRFQFVTTSPEHFGFGHGIHACPGRFFASNEVKILLIHLLMKYDWKFAEDKGRPQGFMHGTEIICDPRVKFLYKARTPEIDLSSLGEGLAA

SEQ ID NO: 1533 - protein, 577 aa, Aspergillus niger
  misc_feature (1)..(577): Public GI ID no. 134078874
  misc_feature (288)..(550): Pfam Name: p450 Pfam Description: Cytochrome P450
  misc_feature (1)..(577): Bit score of 526.7 for HMM based on sequences of Figure 6
  misc_feature (1)..(577): Functional Homolog Of SEQ ID NO. 1429
MVHSFRPTLLLSMSGFSFHTRSSRRIKRIRGSILIDKDGVEQSHRDFGCFKSSFLRFPRRLLLPTPAMAVILEVLDNQHLLQGVVLALVLVFVSSFYHEIADSFPYKNIPLVGKGKWEITNTKAKHRFVTSAKELFAEGFSQGRKAFQVHFSARPTIVLHPSLTNEVKNNPLLDFNEANKKIPGFEPFDGLDHEGIFLEVINKKITQGLGQLTTPLSRETIAVLNEKLPDSGEWLPFTFAQEIPHIVARLSSLVFLGEKICRDKQWLDVSVNYTIHAFVAARDLRLYPTVLRPFVHWFLSSTRRTRQDIRVASAIINREVEKRILIREGKLPEEDPPRTHADTLDWFEEVAAGRPLDLAVAQVGLSLAAIHTTSNLLTNIMYDLTAYPEHIQPLRDEIKAIISEDGGLKKTSLTKMKMMDSVLKESQRMHPAGVAFINRVAMGDITLSDGTRIPKGASIAVSAHNMEDESLYPNAKTYDGFRFYKKRQEPGNEHRFQFVTTSPEHLGFGHGMHACPGRFFASNEVKILLIHFLMRYDWKFADGRTTRPMNFMHGTESICDPTVEFLFKPRQPEVDLS

SEQ ID NO: 1534 - protein, 524 aa, Talaromyces stipitatus
  misc_feature (1)..(524): Public GI ID no. 242795502
  misc_feature (1)..(524): Talaromyces stipitatus ATCC 10500
  misc_feature (106)..(499): Pfam Name: p450 Pfam Description: Cytochrome P450
  misc_feature (1)..(524): Bit score of 544.9 for HMM based on sequences of Figure 6
  misc_feature (1)..(524): Functional Homolog Of SEQ ID NO. 1429
MALTTHLVTDTHHLAQNLTLDTGLTSLSKPKDLVLGLGSIVMITIIAQWIITTYKFWQYPFFNRASFWNPSQAKDNFLANAQKLLIDGFSKAPKGYIMDTDMARTLILSPEYANEIRSDPRLSFRKHNTKDFLGHLFTFELFQDRGKFGEKINDMVRTKLTQSLGLITKDVSNEMADVIHHQWSEDADWHSINLKNTMVEVVAQVSSRVFLGPGLCRNKEWLRITIDYTLLIFDAIRTVKRYPKFLHPLVQWVLPEPRKVRFHMAEARRIIQPVIDQRKAEMASDKATKHNDAIQWLLEISTGTEYDIALAQLALSMAAIHTTGDMITQVIYDICEHPELIQPLREEIIAVMGTDEFKRTSLYNLKLMDSVMKESQRLKPAGMISMRRVATEEVILHDGRRIPKGSMVAISGHWSWDETFYENPEQFDGYRFLKLSKSPATEHMSHFVSTSPQHLAFGYGKNACPGRFFAANEAKIALVHILLKYDFKLDETTPPPKVVKIGWMMASDSQAKLLVRRRKEFSLD

SEQ ID NO: 1535 - protein, 519 aa, Aspergillus fumigatus
  misc_feature (1)..(519): Public GI ID no. 71002914
  misc_feature (1)..(519): Aspergillus fumigatus A1163
  misc_feature (236)..(491): Pfam Name: p450 Pfam Description: Cytochrome P450
  misc_feature (1)..(519): Bit score of 525.8 for HMM based on sequences of Figure 6
  misc_feature (1)..(519): Functional Homolog Of SEQ ID NO. 1429
MDFLQRILGILSSEDVAPALFASSISVLFLILSYQVLYPPSKYSAFPTINGTRWLALSNRRILAEFVTDAQGLMRNGLEKYDIFRIISSIGPMTILHPKYTDEIHNDRQLNFMAVLAKEMFPNYPGFDLFREGTDGSTVLQDAVKFGSSRCLGKSTQLLSDETSTLLQKLWGDEPEWHEVTAKSSVHDIIAHLSALLFYGPELCSHKEWLEVTDEYASVGFLAARQLRLWPPILRPIAQWFLPACRRLRYLASRTRGLIEPVIAARQKEKAICYSHGRQPPVYDDAIEWTERAAKGRPYDAAMSPLLFSINALHTTTDLLTQVILDLSTQPDLIVALRQEILSVKPQQNGWKNASLNQLLLMDSAIKESQRLKPTESILMRRYAMDDLTLADGNKIPKGTVLGIPIFGMRDPKIYVDPDMYDGYRFQKMRDKPGFENKCQLVSTSPWHLGFGHGIHACPGRFLAAVQVKIILCYIVAKYDFKLAGGAPPKVQSVGIELISDTEARLAVRRRQEMVIGLE

SEQ ID NO: 1536 - protein, 394 aa, Colletotrichum higginsianum
  misc_feature (1)..(394): Public GI ID no. 380473273
  misc_feature (182)..(392): Pfam Name: p450 Pfam Description: Cytochrome P450
  misc_feature (1)..(394): Bit score of 478.6 for HMM based on sequences of Figure 6
  misc_feature (1)..(394): Functional Homolog Of SEQ ID NO. 1429
MEVIAPPKHILSSWVESPLFGKTDLWTSLCLGAVLVIVFLTLPQMRRPSRKLPHINPRATFDFFSRGQKLDFLINARRILESGRTRFPGQPYRLMTDVGETVVLPSEFVHDIRNEPGLSFQEAFANNFHPQLPGFEGFAVGSRPDELFQHVIKKRITKLLNQITEPLSTEAKFAVDHIFGSPNEWREFNIKNDILDLISRLSSRVFLGAEVCRNEDWLAITKSYTVNAFLSAEILRPYPSWLRPVAHRFVPQCKTLRRQVSESKRIIEPVLERRREVRRQARESGEPAPSFNDGIDWFEEESRGREYDVVGAQLGLSLVAIHTTTDLLVETMLRIAEHPELFDALRQEIVEVLSVDGWKKTALFNMKLMDSVLKESQRLKPITSAIMNRVATRP

SEQ ID NO: 1537 - protein, 571 aa, Penicillium chrysogenum
  misc_feature (1)..(571): Public GI ID no. 255948452
  misc_feature (1)..(571): Penicillium chrysogenum Wisconsin 54-1255
  misc_feature (129)..(545): Pfam Name: p450 Pfam Description: Cytochrome P450
  misc_feature (1)..(571): Bit score of 502.7 for HMM based on sequences of Figure 6
  misc_feature (1)..(571): Functional Homolog Of SEQ ID NO. 1429
MLLGFGSVRFKLIALDTDVGPPLLEYPVQGRLGEKKDGVSVTVSTLTMAVISELLNSPYVVQSVCIALVAVFITSAWPDIANEIPYRRIPLVGKTWWELTNKKARQRFTQSCRELIAEGFAKPSKGVSVFQIIGATSPIVVLHPKFVDEIKNHPDLSFEDSIKKATFFENRIPGFEPFHNGTALKSTVEIVRTSLTQALGSISLRLSKESGAILKESLPATDEWKPCHFAQKVPYMVARLSSLIFVGETISHDDEWIDVSVNYAIDAFMAMRDLREWPSILHPVVHWFLPSTQKLRKHLKMARSIISREIDRRALIRAGKLPADDPPRGPDALDWYRETAEARNNLTFDQSCAQVGLALAAIHTTSNLLTNVIYDLAAYPEYIQPLRDEIRAVAAEDGVLKKTSLLKLKLMDSVMKESQRTNPLSLTSMNRLAHKQIVLSDGTVIPKGANMFVSTKTLEDDSIYPNASTYDGYRFYKKRQQPGNEHRHQFVTTTSEHFVFGHGIHACPGRFFAANETKIMLLHLLLKYDWKLQSGGRPPNIENGVESITDPRVEILFRSRESEVDLGFLGE

SEQ ID NO: 1538 - protein, 467 aa, Arthroderma benhamiae
  misc_feature (1)..(467): Public GI ID no. 302500503
  misc_feature (1)..(467): Arthroderma benhamiae CBS 112371
  misc_feature (131)..(444): Pfam Name: p450 Pfam Description: Cytochrome P450
  misc_feature (1)..(467): Bit score of 515.6 for HMM based on sequences of Figure 6
  misc_feature (1)..(467): Functional Homolog Of SEQ ID NO. 1429
MLEALIQSGSAYRVDLALSFVVLLVVSYIARLVSHRQRYAKFPLHIDKSNPKQMLLSGFAKYKNAFHINTAIGKDIILSADYANELKSDPHLDFAKAILPVLTETIRSKLSRLPDFFDRKLTLLWSEWHEIPIKETIVKIVARMSSRVFLGEELCRNEEWLRITAEYTINLFIAVNELMTWPTYVRPIVQWFLPPCQRLRQQVADARRLIQPVIDARHAENDELRRQGKPLRQHEDAIAWLDEKSGGRSFDAAIAQLSLSFVSIHTTTDLCTQALYDICANPELIQPLREEITSILGNRELDTTALYQMKLLDSVIKESQRIKPAGLLSMKRYVKENITLSDGLVVPKGTSISISSHVHWDESVYPEPNKFDGYRFLKMKGDREKDRMANLVATSPEHLGFGHGVHACPGRFFAADEIKILLCHILLKYDFRLTEKSNTTPYMMPGGAYMANSTQIEIRRRKEEIAL

SEQ ID NO: 1539 - protein, 527 aa, Aspergillus clavatus
  misc_feature (1)..(527): Public GI ID no. 121714683
  misc_feature (1)..(527): Aspergillus clavatus NRRL 1
  misc_feature (159)..(507): Pfam Name: p450 Pfam Description: Cytochrome P450
  misc_feature (1)..(527): Bit score of 479.9 for HMM based on sequences of Figure 6
  misc_feature (1)..(527): Functional Homolog Of SEQ ID NO. 1429
MFRENLGPIFLTALPAILLSYFLSVALPSLRLQWKTSHIPIINKKKGEWSDSNAVKRCAHNAQAILQEGHEKVDFQLVEEVPSKITDQKHQYTGPFQLIGSFGRRIVLPPELGEHVKTDPRFTASEVVRQTMAGSLPGFEGLLPVMEAGAPNVFIQMIRSKLTSNLGKFTQHLAEETQAAFDEKWGTSTEWHEVDLLASLRDIVTQVSTRIFLGPELCKNKEWLDNTQAYTDNVFKAVRSIRRFPAWSRPYVQWFLKDCSRIRQQVKRAEEIIEPIIAKRLEEIALAQKGLAEMPNDAITWMHQVAQGKGKDYHGAHIQLSLSMASVHTTSDLFSNILLQLCRHPEWIEPLLQEAQSVRSEGGWEKTSLYRMKLADSVMKETQRIKPLGVLLSHRHVSDDVILPDGTLIPKGAIVATNMSRMWDPEFYPNPEEWQPDRYLKRREEPGKEHSSQFVTTTMESLGFGIGSHACPGRFFASSKIKLLLNHVLQNYEFERVDTGKDATPFFVEYVTNPKAKLRVRRKEISS

SEQ ID NO: 1540 - protein, 518 aa, Penicillium citrinum
  misc_feature (1)..(518): Public GI ID no. 23574644
  misc_feature (190)..(492): Pfam Name: p450 Pfam Description: Cytochrome P450
  misc_feature (1)..(518): Bit score of 518.5 for HMM based on sequences of Figure 6
  misc_feature (1)..(518): Functional Homolog Of SEQ ID NO. 1429
MLGQVLLTVESYQWVSTPQALVAVAVLLSLIAYRLRGRQSELQVYNPKKWWELTTMRARQDFDTYGPSWIEAWFSKNDKPLRFIVDSGYCTILPSSMADEFRKIKDMCMYKFLADDFHSHLPGFDGFKEICQDAHLVNKVVLNQLQTQAPKYTKPLATLADATIAKLFGKSEEWQTAPVYSNGLDLVTRTVTLIMVGDKICHNEEWLDIAKNHAVSVAVQARQLRVWPMLLRPLAHWFQPQGRKLRDQVRRARKIIDPEIQRRRAEKAACVAKGVQPPQYVDTMQWFEDTADGRWYDVAGAQLAMDFAGIYASTDLFVGALVDIARHPDLIQPLRQEIRTVIGEGGWTPASLFKLKLLDSCMKETQRIKPVECATMRSTALRDITLSNGLFIPKGELAAVAADRMNNPDVWENPENYDPYRFMRMREDPDKAFTAQLENTNGDHIGFGWNPRACPGRFFASKEIKILLAHILIQYDVKPVPGDDDKYYRHAFSVRMHPTTKLMVRRRNEDIPLPHDRC

SEQ ID NO: 1541 - protein, 512 aa, Zymoseptoria tritici
  misc_feature (1)..(512): Public GI ID no. 339469460
  misc_feature (1)..(512): Zymoseptoria tritici IPO323
  misc_feature (170)..(497): Pfam Name: p450 Pfam Description: Cytochrome P450
  misc_feature (1)..(512): Bit score of 482.6 for HMM based on sequences of Figure 6
  misc_feature (1)..(512): Functional Homolog Of SEQ ID NO. 1429
MLDIPLLFQIIAGAFLLALIYYKLIDVQRPYPGIPVIELDDQKTKSSRPDPSIFATRETELTAKGLETTNGPFQVFTSAGYKIILPNRFAHELRNNPDMSFTRVGDVDFHAQLPGMEPFRELFKSSNGILRDVVQAKLTQSLGLVTEDLVEEADCAIRPWLGDAKDWSDVEVRTFIYNVVGRVSSRIFGGKELARDEEWLGISTRYTISVNQAVNRLRGFPAILRPIAHRFLPESRNAKAELRAAQRLAEPQVEKRLKIREAAIAAGAPPKSLPDVFSWTMEMAKGRQMFLVETQLALSMAAIHTTTEMVMRCLVASCEHPEIQLPLREEMVKVLRSDGWSMSAFYKMKLLDSFMKECQRYFPLSSMAMGRVAEKAVVLSDGTVLPKNSYSIFIDSGTRDNNIYAHPSTFDAWRYLKMRERPGEENQHQFVSTSVDHLGFGHGVHACPGRFFASNEMKIIVCFLLIEYEWRFGSGQERLPDLKFEGSMIANPATKMQVRKREGEIDVLRPMA

SEQ ID NO: 1542 - protein, 342 aa, Gibberella intermedia
  misc_feature (1)..(342): Public GI ID no. 16549051
  misc_feature (1)..(342): Bit score of 804.7 for HMM based on sequences of Figure 7
  misc_feature (1)..(342): in Figure 7
MPHKDNLLESPVGKSVTATIAYHSGPALPTSPIAGVTTLQDCTQQAVAVTDIRPSVSSFTLDGNGFQVVKHTSAVGSPPYDHSSWTDPVVRKEVYDPEIIELAKSLTGAKKVMILLASSRNVPFKEPELAPPYPMPGKSSSGSKEREAIPANELPTTRAKGFQKGEEEGPVRKPHKDWGPSGAWNTLRNWSQELIDEAGDIIKAGDEAAKLPGGRAKNYQGRRWALYTTWRPLKTVKRDPMAYVDYWTADEEDGVSFWRNPPGVHGTFESDVLLTKANPKHKWYWISDQTPDEVLLMKIMDTESEKDGSEIAGGVHHCSFHLPGTEKEEVRESIETKFIAFW

SEQ ID NO: 1543 - protein, 342 aa, Gibberella intermedia
  misc_feature (1)..(342): Public GI ID no. 42661490
  misc_feature (1)..(342): Bit score of 805.2 for HMM based on sequences of Figure 7
  misc_feature (1)..(342): Functional Homolog Of SEQ ID NO. 1542
  misc_feature (1)..(342): in Figure 7
MPHKDTPLESPVGKNVTATIAYHSGPALPTSPIAGVTTLQDCTQQVVAVTDIRPSVSSFTLDGNGFQVVKHASAVGSPPYNHSSWTDPVVRKEVYDPEIIELAKSLTGAKKVMILLASSRNVPFKEPELAPPYPMPGKSNSGSKEGGANPANELPTTRAKGFQKGEEEGPVRKPHKDWGPSGAWNTLRNWSQELIDEAGDIIKAGDEAAKLPGGRAKNYQGRRWALYTTWRPLKPVKRDPMAYVDYWTADGEDGVSFWRNPPGVHGTFESDVLLTKANPKHKWYWISDQTPDEVLLMKIMDTESEKDGSGIAGGVHHCSFHLPGTEKEEVRESIETKFIAFW

SEQ ID NO: 1544 - protein, 342 aa, Gibberella moniliformis
  misc_feature (1)..(342): Public GI ID no. 211970313
  misc_feature (1)..(342): Bit score of 806.2 for HMM based on sequences of Figure 7
  misc_feature (1)..(342): Functional Homolog Of SEQ ID NO. 1542
  misc_feature (1)..(342): in Figure 7
MPHKDTPLEQPVGKNVTATIAYHSGPALPTSPIAGVTTLQDCTQQVVAVTDIRPSVSSFTLDGNGFQVVKHTSVVGSPPYDHSSWTDPVVRKEVYDPEIIELAKSLTGAKKVMILLASSRNVPFKEPELAPPYPMPSKSNKGSKEEVAKPTDELPTTRAKGFQKGEEEGPVRKPHKDWGPSGAWNTLRNWSQELIDEADDIIKAGDEAAKLPGGRAKNYQGRRWALYTPWRPLKPVKRDPMAYVDYWTADDEDGVSLWRNPPGVHGTFESDVLLTKANPKHKWYWISDQTPDEVLLMKIMDTESEKDGSDIAGGVHHCSFHLPGTEKEEVRESIETKFIAFW

SEQ ID NO: 1545 - protein, 346 aa, Fusarium oxysporum
  misc_feature (1)..(346): Public GI ID no. 342877776
  misc_feature (1)..(346): Fusarium oxysporum Fo5176
  misc_feature (1)..(346): Bit score of 793.3 for HMM based on sequences of Figure 7
  misc_feature (1)..(346): Functional Homolog Of SEQ ID NO. 1542
  misc_feature (1)..(346): in Figure 7
MSQQDTHHEPPVGKNVTATIAYHSGPALPTSPIAGVTTLEDCTQQLVAVTDIRPSVSSFTLDGNGFQVVKHISAVSSPPYDHSSWTGPVVRKEVYDPEIIELAKSVTGAKKVMILLASSRNVPFKEPELAPPYPMPSKSSNGCNGGETGPAVRPQHELPTTRAKGFQKGEEEGPVRKPHKDWGPSGAWNTLRNWSQELIDEAGDIIKAGDVAAELPGGRAKNYQGRRWALYTTWRPLKPVKRDPMAYVDYWTADEQDGVSFWRNPPGVHGTFESDVLLTKANPKHKWYWISDQTPDEVLLMKIMDTESEKDGSDVAGGVHHCSFHLPGTEDEEVRESIETKFIAFW

SEQ ID NO: 1546 - protein, 284 aa, Neurospora tetrasperma
  misc_feature (1)..(284): Public GI ID no. 350295800
  misc_feature (1)..(284): Neurospora tetrasperma FGSC 2509
  misc_feature (1)..(284): Bit score of 87.3 for HMM based on sequences of Figure 7
  misc_feature (1)..(284): Functional Homolog Of SEQ ID NO. 1542
METEKPARHDLITTINYYKDLGDGSAPTPVYVGKDQVTNKRLMLPVTTTVTDVTGDDVENSFTLDQNGFQYLKHVSELAREEFADEEKIQREYFAECEGFLKEVTGASRVFAFDHRVRRGPSDWHEIPAYNVRHRGPLHRAHVDQSYAGAEMALREKVPNPGEVGRLMQRRWGIVNIWRPIKPIHKDPLALCDARTVSDADLVPASIILKGGQRRESWTVKANLEHRWYFKYQQLPDEVVLIKCFDSDSSPGMARRAPHCAVEDPDAREEDWRESVEVRCLVFW

SEQ ID NO: 1547 - protein, 388 aa, Gibberella zeae
  misc_feature (1)..(388): Public GI ID no. 46139765
  misc_feature (1)..(388): Gibberella zeae PH-1
  misc_feature (1)..(388): Bit score of 109.9 for HMM based on sequences of Figure 7
  misc_feature (1)..(388): Functional Homolog Of SEQ ID NO. 1542
MGFLSIENIMTTATKPHQGRFRYLTRGSQPTPSKEAYLLPSLSEFGDIVTLPLTDLRPSLDLGQDSPYKLDVHGFTARRHDSALHSAPYSRASWNNEKLLRQIYFPEVEEFVKNVTGCKKAVVSAAVVRNRLYSEGDDSAPAEEEADTQASSSDDTSHMFPPIFGNSVKDGVCPAPKVHLDCTPKGARHHIRRYHSEVALAAEKVIEAENRLLESGVEWNDLKDHSGKVPHFALFSIWRPLKTVHRDPLALSSAASFPVSDYVPCDQREPTDHSIPSHLYRIVGRDDENIDKNDDTYQTQSYLAYAPRDAEKTSHAWHYISEQQPSDVLVIQLFDNEMEGHARAPLEGGKGKSDLGVGGAVHSAFELVDQDEDAEARESIEVRVAAFW

SEQ ID NO: 1548 - protein, 277 aa, Talaromyces stipitatus
  misc_feature (1)..(277): Public GI ID no. 242809430
  misc_feature (1)..(277): Talaromyces stipitatus ATCC 10500
  misc_feature (1)..(277): Bit score of 94.6 for HMM based on sequences of Figure 7
  misc_feature (1)..(277): Functional Homolog Of SEQ ID NO. 1542
MPHSNYETPEVILQYFAPNQDGTPPDANDLEIQYGTKNLHLAAVTLNDLRPDKDKITLTDHGLQLINHDTAMSYEDFNDPEKIKSQYYLEVAEAIKKATGAQKVICFNHNVRSEAAPRLDISKHKVDHIGPMRRVHVDVAPRGTYEAVEKRAGEALMSSIRGRWKIINSWKPLKTVQRDPLAIATGPSCPDEDLVELTRYRPDGSLSESRYSVLYDQRHKWYWVPMQKPNEMLLFNQYSDDPNRTLADRVAHCGFTLPGAEDKEIRESVEVRALVIY

SEQ ID NO: 1549 - protein, 291 aa, Phaeosphaeria nodorum
  misc_feature (1)..(291): Public GI ID no. 169619475
  misc_feature (1)..(291): Phaeosphaeria nodorum SN15
  misc_feature (1)..(291): Bit score of 74.2 for HMM based on sequences of Figure 7
  misc_feature (1)..(291): Functional Homolog Of SEQ ID NO. 1542
MSKDAIERSNDGDVVADINYFPATGKPISKASWKPRYLGEPDQFTRSMTIRDARGKEEEFDLNMKGFTFIRLPPASRVTREDDEETVKRSYYPELEEIAKKLTGASKAHVFNHVMRAHTSPASKGIQDAQGRWQDIPAGHPHVDYADTSGAMLGTRAELNLPLSIDTLFDTSSRYAFLGMWRPLKTVRRDPLAVCDATTVSDKDYQVRLREFSRTGIKSANYVMSHADEKETHEWWYLSQMQPDEMVVFKGFDTKQDLPGWRCPHTAFRVKGSEKEEARESVEARVICFWD

SEQ ID NO: 1550 - protein, 278 aa, Zymoseptoria tritici
  misc_feature (1)..(278): Public GI ID no. 339467588
  misc_feature (1)..(278): Zymoseptoria tritici IPO323
  misc_feature (1)..(278): Bit score of 70.5 for HMM based on sequences of Figure 7
  misc_feature (1)..(278): Functional Homolog Of SEQ ID NO. 1542
HDVETILNFHKDNEDGSPPAPTYVGRPETYERPVDAHKVTIHDVTGDEDKYTLDSHGFQLVPSVSGEKDFLDDDVIKETYYKEIDQLLKDVTGATRTFIFDHTIRRPTPATASDPAQEDQTSPKLNLRGPVRRVHIDQSYSAALSRVPHHLPSEADHLLRGRVQIINVWRPIRTVLRDPLAVAQSQSVAEEDLVPIGLIYDTRKGETLSVKHAEGQKWFYKHHQTPEEVVLIKCFDNRAEDGVRAKRVPHSAFEVEGTEAKEERESIEVRCLVFHEND

SEQ ID NO: 1551 - protein, 283 aa, Colletotrichum higginsianum
  misc_feature (1)..(283): Public GI ID no. 380495415
  misc_feature (1)..(283): Bit score of 96.4 for HMM based on sequences of Figure 7
  misc_feature (1)..(283): Functional Homolog Of SEQ ID NO. 1542
  misc_feature (169)..(169): Xaa is any aa, unknown, or other
MALGTTQEQLLPDMARRTVVTTINYYDDPGDGSPPTPIIVGGQKVTNERKMTPRTMTVTDITGDEDNFTLDTHGFQYIRHTSAEKDFVDDEQVKTVYYPEMEKVYKDITGASRVVIFNHQIRRGPANWHTLGERNTEHRGPLHKAHVDQSYDGAIMMARHHLGDEADEXLKRRFQIINIWRPIKTVQKDPLAVADGNTVAEEDLVPGAIIYPRHRAETWTIKPNPAHRWYFKNRQRPDEPLLIKCFDSDASVVRRAAHCAFRDPDMDDMECRQSIDIRALVFH

SEQ ID NO: 1552 - protein, 392 aa, Penicillium chrysogenum
  misc_feature (1)..(392): Public GI ID no. 255955071
  misc_feature (1)..(392): Penicillium chrysogenum Wisconsin 54-1255
  misc_feature (1)..(392): Bit score of 106.7 for HMM based on sequences of Figure 7
  misc_feature (1)..(392): Functional Homolog Of SEQ ID NO. 1542
MGSITPSLHRGKFRYLTRGAKPAQSKEAYLLPPLSEFGDVLALPLVDMKPSLDLGDDSPYKLSVHGFTARRHHSALHAAPYERRSWNDEHLLREIYFPEVQELVQKVTGCKKVVVSAAVLRNELYTEGDPASATQTEQNGQDAVKKDMSELFPPIVGNSPTDGICPAPKVHLDLTPKGARYHIRKYHREVTSAAEQVIEAENRLLESGVQWDDLKDYYQGKESDDGVPRFALFSIWRPLKPVHRDPLALASCASFPESDYVPSEQLEPMDHQISAHLSRIIDPNAPKLSVENERQVQGGTCQTYGYLAYGPRDKEQKAHGWHFVSEQQPSDVLIIQLFDNEMEAHARAPQEGTNKMSNLGVGGAIHSAFELEGQDIDAEARESIEVRCAAFW

SEQ ID NO: 1553 - protein, 396 aa, Metarhizium anisopliae
  misc_feature (1)..(396): Public GI ID no. 322704192
  misc_feature (1)..(396): Metarhizium anisopliae ARSEF 23
  misc_feature (1)..(396): Bit score of 89.8 for HMM based on sequences of Figure 7
  misc_feature (1)..(396): Functional Homolog Of SEQ ID NO. 1542
MGSTNGSSQVLGEYMHPVVDQNSERGDPWQRSYGAPPPVGDLVPRSSPLIDIRPLLSEPGHTAVGHLKSHGFGVVKHRSASLESCYTNKGEMDEEAVASMYYPEIKELVAKTLGAEYVHVTHSVFRRGARAPEPFKMPTGLKPLPADDGKHGDRGASTEKSKAKQGKPADYWTCRPRMSISTPARVPHLDFTPLSARRTLRFHSQEIYKTALERGMIAAEDTICQDHAFRPSDKESDALIARQYNNTESGRLGPRYAAYSIWRPLKKVARDPLTFSPRKETPASAEDDMVHWRYENRVPGPPELGGDWLKEFAMLGVKAKEPPPEQSPRHASTGSEWYYVSAQETDEVLFVQLFDSASLGEDSQHAGAPWHASPEIGAAAGDELRESIDVRVLVLW

SEQ ID NO: 1554 - protein, 301 aa, Thielavia terrestris
  misc_feature (1)..(301): Public GI ID no. 367036275
  misc_feature (1)..(301): Thielavia terrestris NRRL 8126
  misc_feature (1)..(301): Bit score of 81.2 for HMM based on sequences of Figure 7
  misc_feature (1)..(301): Functional Homolog Of SEQ ID NO. 1542
MAAADVVNPALFDRHQAAISPAIANDGRAAPHNVRTVLNYYKDPGDGTPPAPFYVGKSFEQQQALRPTVSVEVEVTDISGSEDKYTLDSHGFQIVRHESKEKQFLDEEQIKSIYYPETEQLLKDVTGATRVLIFDHTIRRPPKPNGDENALLRGPVRNVHIDQSYTAAVNRVRYHLPDEAEELLKKRFQIINVWRPIKTILKDPLGVADAHSVAESDLVGAALIYPNRKGETFAVKPNPAHRWYFKYAQRPDEVTLIKCYDSVTTPGVARRIPHSAFTDPAEEDKEPRESIEVRTLVFYDY

SEQ ID NO: 1555 - protein, 380 aa, Exophiala dermatitidis
  misc_feature (1)..(380): Public GI ID no. 378732306
  misc_feature (1)..(380): Exophiala dermatitidis NIH/UT8656
  misc_feature (1)..(380): Bit score of 160.7 for HMM based on sequences of Figure 7
  misc_feature (1)..(380): Functional Homolog Of SEQ ID NO. 1542
MSATAAVTTTTTTTTTTTTITTIPSSAALSESQYYGKLRFIPRGQTPTASPHNFHLPAMAEFSDVRLQPLIDLRPVPTVAELPTAKEGTAQLSTHGFTAVRHPTTMNSAPYTRESWKNPRLLRELYVPETEEMVKQITGAKTVITEALLLRSAVWSEEDALATHAGHGQKQEETVPQDEELELGFPQFIGFSPKNGGVSPAPKVHLDYAPNGARTHLRKYHPTMTKAAKDIISAEDKLLSEGKSLPEEYAASGLGPRWALYSIWRPLKRVDRDPLALGDARTFLEDDYVPVMIKTPNLGIPGETTTHDSESYLAHWSPGQKWHFISKQEPEEVLVIGLFDSDRDKDTVAAGGTLHSSVDLPDTGNEEPRESIELRCLAIW

SEQ ID NO: 1556 - protein, 296 aa, Aspergillus flavus
  misc_feature (1)..(296): Public GI ID no. 238497964
  misc_feature (1)..(296): Aspergillus flavus NRRL3357
  misc_feature (1)..(296): Bit score of 79.8 for HMM based on sequences of Figure 7
  misc_feature (1)..(296): Functional Homolog Of SEQ ID NO. 1542
MRPQTIQTFLDYHHSSAFASGEITAGTLKFCRIAPDRQPVQIEDVRGRKEEFRLDEHGFQFLRHESPSFASFRDEDLSTVQQESVEILQRLTGASSVQIFSTLIRNQTDKELFKLIDSSEPDSSVVPFNMPSRRVHVDQSEAGAYLKLKDSMAPDQVERVLQGRWAIINVWRPLKPVPCDPLAVADARSVPDEDLFEVHVGKPQNVQATFYNPKTSRQGSGTLLGKYGPGHKWYYMSDMTQYDILLLKIFDSKDDGKTARRTPHAAFIDPQTSEVQEARESLEIRCLVCFGDGIPG

SEQ ID NO: 1557 - protein, 376 aa, Arthroderma otae
  misc_feature (1)..(376): Public GI ID no. 296803841
  misc_feature (1)..(376): Arthroderma otae CBS 113480
  misc_feature (1)..(376): Bit score of 109.7 for HMM based on sequences of Figure 7
  misc_feature (1)..(376): Functional Homolog Of SEQ ID NO. 1542
MDTVAPAAHRGKFRYLTRGTKPTPRKGAYLLPPLSEFGDVLTLPLTDLRPSLDLGDESPYKLSVHGFTARRHLSALHVAPYGRASWNDEQLLREIYFPEVQALVQRVTGCKKVVISAAVIRSGVYKESDPASAPQTAENGGSSDKAIPALFPPIFGNSTTDGICPAPKVHLDLSPRGARYHIRKYHLEVACAAEQLIDAENRRLESGVQWDDLKDYYGEIPRFALFSIWRPLKTVRRDPLALSSCASFPESDYAPASQLEPMDHRIPAHLSRIVDSVFYEDKGMYQSQSYLAYGPRDKEQKAHDWHFISEQQPSEVLMIQLFDNKMEAHARAPQEGVDKMSDLGVGGAIHSAVELDDQDVEAEPRESIEVRCAAFW

SEQ ID NO: 1558 - protein, 306 aa, Exophiala dermatitidis
  misc_feature (1)..(306): Public GI ID no. 378731760
  misc_feature (1)..(306): Exophiala dermatitidis NIH/UT8656
  misc_feature (1)..(306): Bit score of 79.8 for HMM based on sequences of Figure 7
  misc_feature (1)..(306): Functional Homolog Of SEQ ID NO. 1542
MASAAVQQPTGHSTSFEPLTTQVKGSSLTSQPEKHHVQTKLNYYKYPGDGSRPPPNIAGKPETYDRPSEPLDVTVHDIRGEEDQYTLDKNGFQIYRHASVEKEFLDDEQIKAQYYPEVEQLLKDATGASRVFIFDHTIRRQPKDQRGETPTVNLRGPVNRVHIDQSYSAAKSRVPHHLPDEADKLLKTRYQIINVWRPIKTIYKDPLAVADAHSVPDSDLVGVDLIYPDRRGETYTVRPNPEHKWYYLYGQTPEEVVLIKCFDSKLDGRARRVPHTAFVNPETVDAPPRESIEVRTLVFHEDEPAE

SEQ ID NO: 1559 - protein, 406 aa, Metarhizium acridum
  misc_feature (1)..(406): Public GI ID no. 322696305
  misc_feature (1)..(406): Metarhizium acridum CQMa 102
  misc_feature (1)..(406): Bit score of 90.3 for HMM based on sequences of Figure 7
  misc_feature (1)..(406): Functional Homolog Of SEQ ID NO. 1542
MDSTNGTTQVLGQYMHPVVDQNSERGDPWQRNYGAPPPMGDLVPRTSPLIDIRPLLSDPGYTAVGHLKSHGFGVVKHRSASLESCYTDKGEIDEEAAASAYYPEIKELVAKTLGAKYVHVTHSVFRRGARAPEPFKMPTGLKPLPSVTATGGSKQGDKETSTEKAEEKPTIQAQQSKPADYWSSRPRMSTSTPARVPHLDFTPISARRTLRFQSQEIYKTAVERGMIAAEDTICQNHPFRPSDKESDSLIAEQYNHSESGRLGPRYAAYSIWRPLKKVARDPLTFSPRKEMPVSADCGMVHWQYENKVPGPPELGGDWLKEFAMLGVKAKEVPPEQSPRHANTCSKWYYVSAQETDEVLFVQLFDSASLGVDSQHAGAPWHASPEIGAAAGDEPRESIDVRVVVLW

SEQ ID NO: 1560 - protein, 294 aa, Glomerella graminicola
  misc_feature (1)..(294): Public GI ID no. 310795092
  misc_feature (1)..(294): Glomerella graminicola M1.001
  misc_feature (1)..(294): Bit score of 94.8 for HMM based on sequences of Figure 7
  misc_feature (1)..(294): Functional Homolog Of SEQ ID NO. 1542
MAVGTTQQQPLTGTAQARSADTQPRNRRTVVTTINYYDDPGDGSPPTPIVVGGQKVTNERKMTPRTMTVTDVSGDEDSFTLDTHGFQYIRHTSVEKDFADEETVRSVYYPEMERVYKEITGASRVVIFNHQIRRGPANWHSLGERNTEHRGPLHKAHVDQSYEGAVMMARHHLGDEADELLKRRFQIINIWRPIKTVHKDPLAVADGNTVAEEDLVPGAIIYPRHRAETWTIKPNPAHRWYFKDKQCPDEPLLIKCFDSDTSVVRRAAHCAFRDPEMDDMESRQSIDIRALVFH

SEQ ID NO: 1561 - protein, 296 aa, Aspergillus oryzae
  misc_feature (1)..(296): Public GI ID no. 317141690
  misc_feature (1)..(296): Aspergillus oryzae RIB40
  misc_feature (1)..(296): Bit score of 80.4 for HMM based on sequences of Figure 7
  misc_feature (1)..(296): Functional Homolog Of SEQ ID NO. 1542
MRPQTIQTFLDYHHSSAFASGEITAGTLKFCRIAPDRQPVQIEDVRGRKEEFRLDEHGFQFLRHESPSFASFRDEDLSTVQQESVEILQRLTGASSVQIFSTLIRNQTDKELSKLIDSSEPDSSVVPFNMPSRRVHVDQSEAGAYLKLKDSMAPDQVERVLQGRWAIINVWRPLKPVPCDPLAVADARSVPDEDLFEVHVGKPQNVQATFYNPKTSRQGSGTLLGKYGPGHKWYYMSDMTQYDILLLKIFDSKDDGKTARRTLHAAFIDPHTSEVQEARESLEIRCLVCFGDGIPG

SEQ ID NO: 1562 - protein, 309 aa, Sclerotinia sclerotiorum
  misc_feature (1)..(309): Public GI ID no. 156043835
  misc_feature (1)..(309): Sclerotinia sclerotiorum 1980 UF-70
  misc_feature (1)..(309): Bit score of 75.2 for HMM based on sequences of Figure 7
  misc_feature (1)..(309): Functional Homolog Of SEQ ID NO. 1542
MSTTITQQASSEHITKLNTDPTTPHDVEGIMNYHLDSEDGSPPAPNIVAKPSTYERPVHSVKVTIHDIRGSEDQHTLDTSGFQIVNHVSLEKDFVDEEKIKSDYYKETEELLKRETGASKIFIFDHTIRRQSLNGTDPAPSTTSTATDKENTSPVVVQRGPVQRVHIDQSYIASANRVSYHLPDEANELLKGRFQIINVWRPIKTILKDPLGVAAANSVDDKDLVPIKLIYPDREGETYGVRYDPGHKWHYLYKQTPAEVLLIKCFDSKTDGRARRVPHSAFVNPEHEGEEKRESIEVRALVFYPNDRE

SEQ ID NO: 1563 - protein, 327 aa, Verticillium dahliae
  misc_feature (1)..(327): Public GI ID no. 346978982
  misc_feature (1)..(327): Verticillium dahliae VdLs.17
  misc_feature (1)..(327): Bit score of 125.7 for HMM based on sequences of Figure 7
  misc_feature (1)..(327): Functional Homolog Of SEQ ID NO. 1542
MAVAKVNHGCSIMLASHSRSSMKEFAQSGWLDERHPTQTFQPIITTRSLIFKLVIANATLHAPPHCSLSFRDPELLKQHVIPDTELALKQLTGCTTVVTEALLLRCALWSATDSLAAHGSAGDKASELKTGFPQFIGFDPISGGGSPASKIHLDYSPDGARMHIRRFHPRTAEAAAEIIRVEDSLVAAGKDLSDSYKHSGGPRWALYSTWRPLKTVRRDPLAVLDYTTFKEDDYVPAAVPTPSLGREGVCETHPAECYLARYSQQHKWYWIDNQIPEECLVLRFFDSDEERAGSIAAGGVLHSSAELEGNDDAEPRESLEIRSLCIW

SEQ ID NO: 1564 - protein, 222 aa, Colletotrichum higginsianum
  misc_feature (1)..(222): Public GI ID no. 380482210
  misc_feature (1)..(222): Bit score of 57.5 for HMM based on sequences of Figure 7
  misc_feature (1)..(222): Functional Homolog Of SEQ ID NO. 1542
HKYTLDSHGFQLCSHVSQEKTFDSEERIKQVYYTEVQQLVLKMTGASRLHIFDHTIRRPNPVASHSDEERRPVRQAHIDQSEWASRNQVIRHMGQDATRLLQSRFQIINVWRPIKTIRKDPLAVCDSQSVPDRDILPIKLIYPDWVGEPCTMLPNNDHCWYYKHNQTPEEVMLFKCYESKTDGRARRVPHAAFTDPETVDEEPRQSIEVRVLVFYEDDIDMP

SEQ ID NO: 1565 - protein, 300 aa, Penicillium marneffei
  misc_feature (1)..(300): Public GI ID no. 212545757
  misc_feature (1)..(300): Penicillium marneffei ATCC 18224
  misc_feature (1)..(300): Bit score of 67.8 for HMM based on sequences of Figure 7
  misc_feature (1)..(300): Functional Homolog Of SEQ ID NO. 1542
MATDTVTMPAVIHANINYFLEISEGGTYVIYPGTAADKLRPLKSVVMPVTDLRTCTIDKFTLDTHGFQFVPHQASEKTYDDQARIKTTVYKETAAFLKEVTGATRVFPFSHLVRKHLVDTAVDAAKKVPQLTDIIPIMTPSLLCHIDQSYDGARQVLDANLPTTEAESLSKTRWGIINVWRPIGSAVKRDPLAVCDAGSCTESDLRKVFAQLPSQGDGSKVSRGKGFEVFNVAHNPNHKWYYASSMTPDETLMIKCFDSKLDGRARRTPHTAFQTEFDEGPARQSIEVRCLVFWEDQSVE

SEQ ID NO: 1566 - protein, 291 aa, Aspergillus terreus
  misc_feature (1)..(291): Public GI ID no. 115399682
  misc_feature (1)..(291): Aspergillus terreus NIH2624
  misc_feature (1)..(291): Bit score of 89.6 for HMM based on sequences of Figure 7
  misc_feature (1)..(291): Functional Homolog Of SEQ ID NO. 1542
MTRATVTTTLNYHIPNGCTEINLGTAEMMRLEPDTHQVEIEDIRGHESEFNLDTHGFALYSHVSKYIPPEDESIIRNEIYAETAEMLKEITGATRVHVFSHLLRRADSKDMAKWAASTTSKRVADAVPPARVVHIDQSESGAHTILRQNLGEEADRLQKTRWALINVWRPLEPIRRDPLALCDARTADDKDLVCLVARLPAEPTGDNKYNDLTKGRAFDMYRVLYSEHHRWYYASDMVPEEVLLLKIFDSKDDVAKRTPHSAFEDPSLDPTGGTRKSMEIRCLVFWEDTEA

SEQ ID NO: 1567 - protein, 357 aa, Verticillium albo-atrum
  misc_feature (1)..(357): Public GI ID no. 302417990
  misc_feature (1)..(357): Verticillium albo-atrum VaMs.102
  misc_feature (1)..(357): Bit score of 131.7 for HMM based on sequences of Figure 7
  misc_feature (1)..(357): Functional Homolog Of SEQ ID NO. 1542
MFATITVHAEQSRSAAALTKAKLRYVAEGHTPQPSPHNFHLPDITEFGDTHFLPLHSVRPVPALDELTTSSSHVSLRDHGFTAIRRPTALHAPPHCPDSFKNPELLKQHVIPDTELALKQLTGCTTVVTEALLLRCALWSATDSLATHGSAGDNTSELKTGFPQFIGFDPISGGGSPASKIHLDYSPDGARMHIRRFHPQTAEAAAEIIRFEDSLLAAGKDLSDSYKHSGGPRWALYSTWRPLKTVRRDPLAVLDYTTFREDDYVPAAVPTPSLGREGVCETHSAECYLARYSQQHKWYWIDNQTPEECLVLRFFDSDEERAGSIAAGGVLHSSAELEDNDDAEPRESLEIRSLCIW

SEQ ID NO: 1568 - DNA, 368 bp, Oryza sativa
  misc_feature (1)..(368): RNAi sequence for CeresAnnot:200242600
  misc_feature (1)..(368): Fragment of rice gene locus Os03g49990
  misc_feature (1)..(368): fragment of Functional Homolog Of SEQ ID NO. 188
cagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattc

SEQ ID NO: 1569 - DNA, 97 bp, Oryza sativa
  misc_feature (1)..(97): RNAi sequence for CeresAnnot:200242600
  misc_feature (1)..(97): Fragment of rice gene locus Os03g49990
  misc_feature (1)..(97): fragment of Functional Homolog Of SEQ ID NO. 188
ctacctcaagttcgcccacttcaccgcaaatcaagccatcctcgaggctttcgccggctgccaccgcgtccacgtcgtcgacttcggcatcaagcag

SEQ ID NO: 1570 - DNA, 994 bp, Miscanthus sinensis
  misc_feature (1)..(994): useful for RNAi constructs to decrease expression
  misc_feature (1)..(994): fragment of Functional Homolog Of SEQ ID NO. 188
cttgaggctcgtttggcaggcactgggagtcagctttaccgtatgcttatagcaaaacgtacaactgcctcagacatgcttaaagcctaccacctctaccttgcagcatgcccattcaagaggctttcacattttctttccaatcaaacaatcttgagtatgattaaaaatgcatcaaaggtgcatatcattgacttcggcatttatttcggcttccaatggccatgcctaatcaggcgtctctccaagagggaaggcggtccacctgttctgcgcatcactggaattgatgtacctcagccaggtttccgcccttccgagagaattgaagagactggacgaaggcttgcagaatatgctgcgaagttcaaggtgccttttgagtatcagggaatagcatcaaagtgggaaaccatccgagttgaggatctcaaagttggcaaggacgaagttgtgattgttaattgcctatacagattcagaaacctgattgatgaaacagttgctgtagacagtcctaggaatagagtgctcaacacaataaggcaagtaaacccagcgattttcatccatggaattgtgaatgggtcatacagtgttcccttcttcatcacacgtttccgtgaggcactgttccatttctctgcattgtttgacatgctagagacaactgtcccacgggatgatccccagcgcgcactcatagagagggaaatgtttggccgagaggcactcaatgttattgcatgtgagggctcagacagagttgagagacccgagacatacaaacagtggcaggtgaggaacctcagggctggatttgttcagtctccgttaaaccaagaaattgtgatgaaagccaaggacaaagtaaaagacatttatcacaaggacttcgtcatagatgaagacagtgggtggctcctgcaaggctggaaaggaaggataatctatgcgatatctacatggaagcctaagaagaactagattcttg

SEQ ID NO: 1571 - DNA, 344 bp, Miscanthus sinensis
  misc_feature (1)..(344): useful for RNAi constructs to decrease expression
  misc_feature (1)..(344): fragment of Functional Homolog Of SEQ ID NO. 188
gaccaggtcatgtccgaggtgtacctgggccggcagatctgcaacgtcgtggcatgtgagggcgcggagcgcacggagcgccacgagacgctgggtcagtggcgcagccgcctcggcggctccgggttcgagcccgtgcacctgggctccaatgcctacaagcaggcgagcacgctgctggcactcttcaacggcggcgacgggtacaaggtggaggagaaggatgggtgcctgaccctggggtggcatacgcgcccgctcatcgccacctcggcgtggcgcctcgccgctccgtgatcgaggggtggggttttggacggctgatcaaggcacacgtcccccgg

SEQ ID NO: 1572 - DNA, 205 bp, Miscanthus sinensis
  misc_feature (1)..(205): useful for RNAi constructs to decrease expression
  misc_feature (1)..(205): fragment of Functional Homolog Of SEQ ID NO. 188
caagtttccaacccacctgctgcaaggcgtcggtctcgtcgtgctgcggtgggccgacgccggtgagtcggaacgatgggggcccgccagggcggagggcgagggcctggagaagagccggccactgcaacccatgcttgatgccgaagtcgacgacgtggacgcggcggcagccggcgaaagcctcgaggatggcctggttcgc

SEQ ID NO: 1573 - DNA, 218 bp, Miscanthus sinensis
  misc_feature (1)..(218): useful for RNAi constructs to decrease expression
  misc_feature (1)..(218): fragment of Functional Homolog Of SEQ ID NO. 188
gacggcggcccgccggggcggagcgccagggcctggatcagcgtgggccactggaggccctgcatcaggctgaagtcgatgatgtggacgtgcctgcagccctggacggcctccaggatggcctggttggccgtgaagtgcgcgaacttgaggtacggccccgcctcgtagaagcggtggtagaggaaggctccgtcggcgacttcggcggcgggcgg

SEQ ID NO: 1574 - DNA, 248 bp, Miscanthus sinensis
  misc_feature (1)..(248): useful for RNAi constructs to decrease expression
  misc_feature (1)..(248): fragment of Functional Homolog Of SEQ ID NO. 188
cccgcgacgcaagcgtccgcggcggccaacgggcccgcggtgccggtggtggtgatggacacgcaggaggctgggatccggctcgtgcacgcgctgctggcgtgcgcggaggccgtgcagcaggagaacttctctgcggcggacgcgctggtcaagcagatccccatgctggcctcgtcgcagggcggtgccatgcgcaaggtcgccgcctacttcggcgaggcgcttgctcgccgcgtgtatcgctt

SEQ ID NO: 1575 - DNA, 128 bp, Miscanthus sinensis
  misc_feature (1)..(128): useful for RNAi constructs to decrease expression
  misc_feature (1)..(128): fragment of Functional Homolog Of SEQ ID NO. 188
gcggggagggcgggccaatgccggtgaggcggagcgacggcggcccgccggggcggagcgccagggcctggatcagcgtgggccactggaggccctgcatcaggctgaagtcgatgatgtggacgtgc

SEQ ID NO: 1576 - DNA, 111 bp, Miscanthus sinensis
  misc_feature (1)..(111): useful for RNAi constructs to decrease expression
  misc_feature (1)..(111): fragment of Functional Homolog Of SEQ ID NO. 188
gtccacatcatcgacttcagcctcatgcagggcctccagtggcccgcgctgatccaggccctggcgctccgccccggcgggccgccgtcgctccgcctcaccggcattggc

SEQ ID NO: 1577 - DNA, 400 bp, Miscanthus sinensis
  misc_feature (1)..(400): useful for RNAi constructs to decrease expression
  misc_feature (1)..(400): fragment of Functional Homolog Of SEQ ID NO. 287
cacaccgacccgcagctcatctccgtgctgcgctccaacggcacgtccggcctgcagatcgcgctccgcgacggcgcgcagtgggtctccgtgccctccgaccgcgacgccttcttcgttaacgtcggcgactcgttgcaggtgctgaccaacgggaggttcaagagcgtgaagcaccgggtggtgaccaacagcctcaagtctagggtttccttcatctacttcgcgggaccgccgctggagcagcggatcgtgccgctgccggagctgctggcggagggcgaggagagcctgtacaaggagttcacgtggggcgagtacaagaaggccgcgtacaagacgaggctcggcgacaacaggctggcccagtttgaagcgtagcatctagctagcgagctag

SEQ ID NO: 1578 - DNA, 378 bp, Miscanthus sinensis
  misc_feature (1)..(378): useful for RNAi constructs to decrease expression
  misc_feature (1)..(378): fragment of Functional Homolog Of SEQ ID NO. 287
tccggaaccgcccgttggtcagcacctgcaatgcgtcgccgacattgacgaagaaggaccgggtgtcggagggcacggagacccaggtgccgtcccgcagcgacatctccagcccggccgcgtcgttggagcggagcacggagatgatctgcgggtccgtgtgctcgccgaaccccgtcagccgcctcctcacctccgccggctcgccggcggcctcgggccgcgccgggtagtggttcaccctcagcagcgagtcgctgtcccggtccagcaccagcctgctgagcacgccctcgtcgtccaggcccagaccttgcgccatcagctccagcaccgtgcacgtcatgcgtcgcaccgccgcgatgtactcgtccaaaa

SEQ ID NO: 1579 - DNA, 190 bp, Miscanthus sinensis
  misc_feature (1)..(190): useful for RNAi constructs to decrease expression
  misc_feature (1)..(190): fragment of Functional Homolog Of SEQ ID NO. 287
ccagccccggcagcggcgccaggcgctggcgcggtggcggcccgccgaagaagatgaccgacaccctcggccgcgcgctgctcaccaccacccggtgccgcacgctccggaaccgcccgttggtcagcacctgcaatgcgtcgccgacattgacgaagaaggaccgggtgtcggagggcacggagaccca

SEQ ID NO: 1580 - DNA, 170 bp, Miscanthus sinensis
  misc_feature (1)..(170): useful for RNAi constructs to decrease expression
  misc_feature (1)..(170): fragment of Functional Homolog Of SEQ ID NO. 287
tcagcatgactgcatgcatgctagcttcttcgttcgttcctgcgacgtgcatacgacgactgatgatgctgtgcgcgcgtgcaggtgttgacgaacgggaggttcaggagcgtgaggcacagggtggtggtgaacagtgagaagtcccgggtgtccatggtcttcttcgg

What is claimed is:

1. A method of producing a sorghum plant having increased plant height and having biomass with increased saccharification efficiency, said method comprising:
   growing a sorghum plant comprising an exogenous nucleic acid, said exogenous nucleic acid comprising a heterologous regulatory region operably linked to a nucleotide sequence encoding a polypeptide having 95 percent or greater sequence identity to the amino acid sequence of SEQ ID NO:473; and
   selecting said plant for having increased plant height and having a biomass with increased saccharification efficiency, resulting in an at least 2.0 fold increase in glucose, fructose, and sucrose, relative to the plant height and the saccharification efficiency of a biomass of a control plant that does not comprise said nucleic acid.

2. The method of claim 1, wherein the nucleotide sequence encodes a polypeptide comprising the amino acid sequence of SEQ ID NO:473.

3. The method of claim 1, wherein selecting said plant comprises selecting said plant for having an increase in sugar concentration relative to a control plant that does not comprise said nucleic acid.

* * * * *